(12) United States Patent
Patterson et al.

(10) Patent No.: US 10,226,489 B2
(45) Date of Patent: Mar. 12, 2019

(54) COMPOSITION OF BACTEROIDES THETAIOTAOMICRON FOR IMMUNE MODULATION

(71) Applicant: 4D PHARMA RESEARCH LIMITED, Aberdeen (GB)

(72) Inventors: Angela Margaret Patterson, Norwich (GB); George Grant, Aberdeen (GB); Imke Mulder, Aberdeen (GB)

(73) Assignee: 4D Pharma Research Limited (GB)

( * ) Notice: Subject to any disclaimer, the term of this patent is extended or adjusted under 35 U.S.C. 154(b) by 0 days.

(21) Appl. No.: 15/631,945

(22) Filed: Jun. 23, 2017

(65) Prior Publication Data

US 2017/0326184 A1 Nov. 16, 2017

Related U.S. Application Data

(63) Continuation of application No. PCT/GB2015/054112, filed on Dec. 22, 2015.

(51) Int. Cl.

| C12N 1/04 | (2006.01) |
| A61K 35/74 | (2015.01) |
| A23L 33/135 | (2016.01) |
| C12R 1/01 | (2006.01) |
| A61K 9/00 | (2006.01) |
| A61K 9/19 | (2006.01) |

(52) U.S. Cl.
CPC ............ *A61K 35/74* (2013.01); *A23L 33/135* (2016.08); *A61K 9/0053* (2013.01); *A61K 9/19* (2013.01); *C12N 1/04* (2013.01); *C12R 1/01* (2013.01); *A23V 2002/00* (2013.01)

(58) Field of Classification Search
None
See application file for complete search history.

(56) References Cited

U.S. PATENT DOCUMENTS

| 4,683,202 A | 7/1987 | Mullis |
| 5,589,168 A | 12/1996 | Allen et al. |
| 5,925,657 A | 7/1999 | Seed et al. |
| 7,749,494 B2 | 7/2010 | Renaud et al. |
| 7,998,474 B2 | 8/2011 | Kelly |
| 8,460,648 B2 | 6/2013 | Borody |
| 9,011,834 B1 | 4/2015 | McKenzie et al. |
| 9,314,489 B2 | 4/2016 | Kelly et al. |
| 9,371,510 B2 * | 6/2016 | Moore .................... C12N 1/20 |
| 9,376,473 B2 | 6/2016 | Gleiberman et al. |
| 9,539,293 B2 | 1/2017 | Kelly et al. |
| 9,610,307 B2 | 4/2017 | Berry et al. |
| 9,662,381 B2 | 5/2017 | Honda et al. |
| 9,796,762 B2 | 10/2017 | Kelly et al. |
| 9,808,519 B2 | 11/2017 | Honda et al. |
| 9,974,815 B2 | 5/2018 | Mulder et al. |
| 9,987,311 B2 | 6/2018 | Mulder et al. |
| 2003/0147858 A1 | 8/2003 | Renaud et al. |
| 2006/0073161 A1 | 4/2006 | Breton |
| 2007/0286913 A1 | 12/2007 | Swain et al. |
| 2008/0069861 A1 | 3/2008 | Brown et al. |
| 2010/0284973 A1 | 11/2010 | Schiffer-Mannioui et al. |
| 2010/0303782 A1 | 12/2010 | Cobb et al. |
| 2010/0311686 A1 | 12/2010 | Kasper et al. |
| 2010/0316617 A1 | 12/2010 | Renaud et al. |
| 2011/0086011 A1 | 4/2011 | Kasper et al. |
| 2013/0195802 A1 | 8/2013 | Moore |
| 2014/0037716 A1 | 2/2014 | Nowill et al. |
| 2014/0147425 A1 | 5/2014 | Henn et al. |
| 2014/0154218 A1 | 6/2014 | Kohno et al. |
| 2014/0199281 A1 | 7/2014 | Henn et al. |
| 2014/0335131 A1 | 11/2014 | Mazmanian et al. |
| 2014/0341921 A1 | 11/2014 | Honda et al. |
| 2015/0071957 A1 | 3/2015 | Kelly et al. |
| 2015/0104418 A1 | 4/2015 | Flint et al. |
| 2016/0067188 A1 | 3/2016 | Cade et al. |
| 2016/0184370 A1 | 6/2016 | McKenzie et al. |
| 2016/0199424 A1 | 7/2016 | Berry et al. |
| 2016/0279177 A1 | 9/2016 | Kelly et al. |
| 2017/0143772 A1 | 5/2017 | Mulder et al. |
| 2017/0143773 A1 | 5/2017 | Mulder et al. |
| 2017/0143774 A1 | 5/2017 | Mulder et al. |
| 2017/0143775 A1 | 5/2017 | Mulder et al. |
| 2017/0173089 A1 | 6/2017 | Kelly |
| 2017/0354695 A1 | 12/2017 | Grant et al. |
| 2017/0360856 A1 | 12/2017 | Grant et al. |

(Continued)

FOREIGN PATENT DOCUMENTS

| CN | 101590081 A | 12/2009 |
| CN | 102940652 A | 2/2013 |
| CN | 103156888 A | 6/2013 |

(Continued)

OTHER PUBLICATIONS

Wrzosek et al. BMC Biology 2013, 11:61, pp. 1-13.*
ATCC Catalog, https://www.atcc.org/Search_Results.aspx? dsNav=Ntk:PrinnarySearch%7cBacteroides+thetaiotaonnicron%7c3%7c,Ny:True,Ro:0,N:1000552&searchTerms=Bacteroides+thetaiotaonnicron&redir=1, accessed May 2, 2018.*
Kelly et al., Trends in Immunology vol. 26 No. 6 Jun. 2005.*
Barry et al., Journal of Clinical Microbiology. Jan. 1988, p. 13-17.*
Falony et al., Applied and Environmental Microbiology, Apr. 2009, p. 2312-2319 vol. 75, No. 8.*
Yu et al., Glycobiology vol. 23 No. 11 pp. 1281-1292, 2013.*
Altschul et al. 'Basic local alignment search tool.' Journal of Molecular Biology. 1990, vol. 215, No. 3, pp. 403-410.
An et al. (1985) "New cloning vehicles for transformation of higher plants," EMBO J. 4:277-284.

(Continued)

*Primary Examiner* — Irene Marx
(74) *Attorney, Agent, or Firm* — Wilson Sonsini Goodrich & Rosati

(57) ABSTRACT

The present invention provides a strain of *Bacteroides thetaiotaomicron* and derivatives thereof, and the use of said strain or derivatives in treating inflammatory, autoimmune and allergic disorders. The invention also provides pharmaceutical compositions, nutritional supplements, feedstuffs, food products, dietary supplements, and food additives comprising said strain or derivatives.

14 Claims, 12 Drawing Sheets

Specification includes a Sequence Listing.

(56) References Cited

U.S. PATENT DOCUMENTS

2017/0368110 A1 12/2017 Grant et al.

FOREIGN PATENT DOCUMENTS

| | | |
|---|---|---|
| CN | 103652322 A | 3/2014 |
| CN | 103981115 A | 8/2014 |
| CN | 102940652 B | 3/2015 |
| CN | 104546932 A | 4/2015 |
| CN | 104546933 A | 4/2015 |
| CN | 104546934 A | 4/2015 |
| CN | 104546935 A | 4/2015 |
| CN | 104546940 A | 4/2015 |
| CN | 104546942 A | 4/2015 |
| EP | 1448995 A1 | 8/2004 |
| EP | 2687227 A1 | 1/2014 |
| EP | 2810652 A2 | 12/2014 |
| EP | 2832859 A1 | 2/2015 |
| JP | H08259450 A | 10/1996 |
| JP | 2003261453 A | 9/2003 |
| JP | 2005097280 A | 4/2005 |
| JP | 2007084533 A | 4/2007 |
| JP | 2007116991 A | 5/2007 |
| JP | 2009507023 A | 2/2009 |
| JP | 2010246523 A | 11/2010 |
| JP | 2013527240 A | 6/2013 |
| JP | 2015500792 A | 1/2015 |
| KR | 20100128168 A | 12/2010 |
| WO | WO-9117243 A1 | 11/1991 |
| WO | WO-9843081 A1 | 10/1998 |
| WO | WO-9857631 A1 | 12/1998 |
| WO | WO-9919459 A1 | 4/1999 |
| WO | WO-9945955 A1 | 9/1999 |
| WO | WO-01016120 A1 | 3/2001 |
| WO | WO-0185187 A1 | 11/2001 |
| WO | WO-03046580 A1 | 6/2003 |
| WO | WO-2007027761 A2 | 3/2007 |
| WO | WO-2007136719 A2 | 11/2007 |
| WO | WO-2008055703 A2 | 5/2008 |
| WO | WO-2009027753 A1 | 3/2009 |
| WO | WO-2009072889 A1 | 6/2009 |
| WO | WO-2009154463 A2 | 12/2009 |
| WO | WO-2011110918 A1 | 9/2011 |
| WO | WO-2011149335 A1 | 12/2011 |
| WO | WO-2011152566 A2 | 12/2011 |
| WO | WO-2011153226 A2 | 12/2011 |
| WO | WO-2012024638 A2 | 2/2012 |
| WO | WO-2011153226 A3 | 3/2012 |
| WO | WO-2012142605 A1 | 10/2012 |
| WO | WO-2013008039 A2 | 1/2013 |
| WO | WO-2013037068 A1 | 3/2013 |
| WO | WO-2013050792 A1 | 4/2013 |
| WO | WO-2013080561 A1 | 6/2013 |
| WO | WO-2013124725 A1 | 8/2013 |
| WO | WO-2014001368 A1 | 1/2014 |
| WO | WO-2014067976 A1 | 5/2014 |
| WO | WO-2014075745 A1 | 5/2014 |
| WO | WO-2014078911 A1 | 5/2014 |
| WO | WO-2014121298 A2 | 8/2014 |
| WO | WO-2014121304 A1 | 8/2014 |
| WO | WO-2014137211 A1 | 9/2014 |
| WO | WO-2014145958 A2 | 9/2014 |
| WO | WO-2014152338 A1 | 9/2014 |
| WO | WO-2014167338 A1 | 10/2014 |
| WO | WO-2014201037 A2 | 12/2014 |
| WO | WO-2015006355 A2 | 1/2015 |
| WO | WO-2015013214 A2 | 1/2015 |
| WO | WO-2015021936 A1 | 2/2015 |
| WO | WO-2015095241 A2 | 6/2015 |
| WO | WO-2015156419 A1 | 10/2015 |
| WO | WO-2015156519 A1 | 10/2015 |
| WO | WO-2015169944 A1 | 11/2015 |
| WO | WO-2016019506 A1 | 2/2016 |
| WO | WO-2016057671 A1 | 4/2016 |
| WO | WO-2016102950 A1 | 6/2016 |
| WO | WO-2016102951 A1 | 6/2016 |
| WO | WO-2017148596 A1 | 9/2017 |
| WO | WO-2018011594 A1 | 1/2018 |

OTHER PUBLICATIONS

An et al. (1986) "Transformation of Tobacco, Tomato, Potato, and *Arabiodopsis thaliana* Using a Binary Ti Vector System," Plant Physiol. 81:301-305.

Ausubel et al. (1999) Short Protocols in Molecular Biology. 4th edition. pp. 7-58 to 7-60, and Chapter 18. pp. 18-1 to 18-23.

Berg et al. (1996) "Enterocolitis and colon cancer in interleukin-10-deficient mice are associated with aberrant cytokine production and CD4(+) TH1-like responses," The Journal of Clinical Investigation. 98(4):1010-1020.

Claims to be granted in European Application No. 15817513.3.

Co-pending U.S. Appl. No. 15/357,850, filed Nov. 21, 2016.

Co-pending U.S. Appl. No. 15/359,144, filed Nov. 22, 2016.

Co-pending U.S. Appl. No. 15/592,178, filed May 10, 2017.

Co-pending U.S. Appl. No. 15/631,952, filed Jun. 23, 2017.

Database UniProt [Online] Jun. 1, 2003 (Jun. 1, 2003), "subname:Full= possible pirin family protein {ECO:0000313|EMBL:AAO75294. 1};", XP002753666,retrieved from EBI accession No. UNIPROT:Q8ABC3 Database accession No. Q8ABC3.

European Communication dated Jun. 14, 2017 for EP Application No. 15817513.3.

Frame et al. (1994) "Production of fertile transgenic maize plants by silicon carbide whisker-mediated transformation," The Plant Journal. 6:941-948.

Gennaro, A.R., Remington's Pharmaceutical sciences, Mack publishing co. 1985.

Hinnen et al. (1978) "Transformation of yeast," Proc. Natl. Acad. Sci. USA. 75:1929-1933.

International Preliminary Report dated Mar. 1, 2017 for International Application No. PCT/GB2015/054113.

International Search Report dated Feb. 10, 2016 for International Application No. PCT/GB2015/054113.

International Search Report dated Mar. 7, 2016 for International Application No. PCT/GB2015/054112.

International Search report dated Mar. 15, 2003 for International Application No. PCT/GB2002/05255.

Ito et al. (1983) "Transformation of Intact Yeast Cells Treated with Alkali Cations," J. Bacteriology. 153:163-168.

Lopez-Boado, Y. S. et al., Bacterial Exposure Induces and Activates Matrilysin in Mucosal Epithelial Cells. J Cell Biol148, 1305-1315 (2000).

Mahowald et al. 'Characterizing a model human gut microbiota composed of members of its two dominant bacterial phyla.' Proceedings of the National Academy of Sciences. 2009, vol. 106, No. 14, pp. 5859-5864.

Matthes, et al., Simultaneous rapid chemical synthesis of over one hundred oligonucleotides on a microscale. Apr. 1984. EMBO Journal, 3(4): p. 801-805.

Notice of Allowance dated Mar. 30, 2011 for U.S. Appl. No. 10/285,224.

Office Action dated Jan. 11, 2005 for U.S. Appl. No. 10/285,224.

Office Action dated Jan. 26, 2009 for U.S. Appl. No. 10/275,706.

Office Action dated Feb. 18, 2010 for U.S. Appl. No. 10/285,224.

Office Action dated Mar. 13, 2013 for U.S. Appl. No. 12/760,926.

Office Action dated Mar. 26, 2007 for U.S. Appl. No. 10/275,706.

Office Action dated Apr. 4, 2008 for U.S. Appl. No. 10/285,224.

Office Action dated May 2, 2007 for U.S. Appl. No. 10/285,224.

Office Action dated May 2, 2008 for U.S. Appl. No. 10/275,706.

Office Action dated May 25, 2016 for U.S. Appl. No. 14/249,710.

Office Action dated May 26, 2009 for U.S. Appl. No. 10/285,224.

Office Action dated May 26, 2017 for U.S. Appl. No. 15/357,850.

Office Action dated May 30, 2006 for U.S. Appl. No. 10/285,224.

Office Action dated Jun. 26, 2017 for U.S. Appl. No. 15/357,936.

Office Action dated Jul. 6, 2017 for U.S. Appl. No. 15/070,605.

Office action dated Jul. 8, 2015 for U.S. Appl. No. 14/349,907.

Office Action dated Jul. 31, 2017 for U.S. Appl. No. 15/359,988.

Office Action dated Aug. 21, 2013 for U.S. Appl. No. 12/760,926.

(56) References Cited

OTHER PUBLICATIONS

Office Action dated Sep. 4, 2015 for U.S. Appl. No. 14/249,710.
Office Action dated Sep. 17, 2010 for U.S. Appl. No. 10/285,224.
Office Action dated Oct. 12, 2005 for U.S. Appl. No. 10/285,224.
Office Action dated Oct. 28, 2009 for U.S. Appl. No. 10/275,706.
Office Action dated Oct. 30, 2008 for U.S. Appl. No. 10/285,224.
Office Action dated Nov. 6, 2006 for U.S. Appl. No. 10/285,224.
Office Action dated Nov. 23, 2015 for U.S. Appl. No. 14/232,475.
Office Action dated Dec. 13, 2012 for U.S. Appl. No. 12/760,926.
Office Action dated Dec. 19, 2005 for U.S. Appl. No. 10/275,706.
Pang, et al., Crystal structure of human pirin: an iron-binding nuclear protein and transcription cofactor. Journal of Biological Chemistry, 279(2); Jan. 9, 2004:1491-1498.
Simon, et al., Peptoids: A modular approach to drug discover, Oct. 1992. PNAS, 89(20):9367-9371.
Sonnenburg, et al., Genomic and Metabolic Studies of the Impact of Probiotics on a Model Gut Symbiont and Host. PLoS Biol 4(12): e413. https://doi.org/10.1371/journal.pbio.0040413.
Srutkova, D. et al., Efficiency of PCR-based methods in discriminating *Bifidobacterium longum* ssp. longum and *Bifidobacterium longum* ssp. infantis strains of human origin.J Microbiol Methods. Oct. 2011;87(1):10-6. doi: 10.1016/j.mimet.2011.06.014. Epub Jul. 2, 2011.
Tatusova et al. (1999) "BLAST 2 Sequences, a new tool for comparing protein and nucleotide sequences," FEMS Microbial. Lett. 174(2):247-250.
Tatusova et al., Erratum to BLAST 2 Sequences, a new tool for comparing protein and nucleotide sequences, FEMS Microbiology Letters 177 (1999) 187-188.
Teng, L. J. et al., PCR Assay for Species-Specific Identification ofBacteroides thetaiotaomicron. J Clin Microbiol38, 1672-1675 (2000).
Wendler, et al., Identification of a pirin, a novel highly conserved nuclear protein. J. Biol Chem. Mar. 28, 1997; 272(13):8482-9.
Xu, et al., A genomic view of the human-Bacteroides thetaiotaomicron symbiosis. Science. Mar. 28, 2003; 299(5615):2074-6.
An et al. (1988) "Binary Vectors," Plant Molecular Biology Manual. A3:1-19.
Archer et al. (1997) "The Molecular Biology of Secreted Enzyme Production by Fungi," Critical Reviews Biotechnology. 17(4):273-306.
Beggs (1978) "Transformation of yeast by a replicating hybrid plasmid," Nature. 275:104-109.
Butcher et al. (1980) The role of tissue culture in the study of crown-gall tumorigenesis. Tissue Culture Methods for Plant Pathologists. Eds.: Ingrams, D. S.; Helgeson, J.P. pp. 203-208.
Christou (1994) "Genetic engineering of crop legumes and cereals: current status and recent advances," Agro-Food Industry Hi-Tech. pp. 17-27.
Clinical Trials for Thetanix, EU Clinical Trials Register, Date of commencement of clinical trial: Oct. 16, 2015. Available at: https://clinicaltrialsregister.eu/ctr-search/search?query=Thetanix.
Co-pending U.S. Appl. No. 15/704,245, filed Sep. 14, 2017.
Co-pending U.S. Appl. No. 15/803,721, filed Nov. 3, 2017.
Co-pending U.S. Appl. No. 15/803,723, filed Nov. 3, 2017.
Co-pending U.S. Appl. No. 15/842,635, filed Dec. 14, 2017.
Davis et al. (1971) "Genetic and Microbiological Research Technqiues," Methods Enzymol. 17A:79-143.
GT Biologics obtains FDA orphan drug designation for paediatric crohn's drug, pharmaceutical-technology.com news, Oct. 8, 2013. Available at: http://www.pharmaceutical-technology.com/news/newsgt-biologics-obtains-fda-orphan-drug-designation-for-paediatric-crohns-drug?WT.mc_id=DN_News.
Holland et al. (1990) "Secretion of Heterologous Proteins in *Escherichia coli*," Methods Enzymology. 182:132-143.
Hollenberg et al. (1997) "Production of recombinant proteins by methulotrophic yeasts," Current Opinion Biotechnology. 8(5):554-560.
Hooper at al. 'Molecular analysis of commensal host-microbial relationships in the intestine.' Science. vol. 291, No. 5505, pp. 881-884.
Kelly et al. 'Commensal anaerobic gut bacteria attenuate inflammation by regulating nuclear-cytoplasmic shuttling of PPAR-y and ReiA.' Nature Immunology. 2003, vol. 5, No. 1, pp. 104-112.
Lavallie et al. (1995) "Gene fusion expression systems in *Escherichia coli*," Current Opinion Biotechnology. 6 (5):501-506.
Meyer et al. (1992) "The use of cassava mosaic virus as a vector system for plants," Gene. 110:213-217.
Office Action dated Jan. 2, 2018 for U.S. Appl. No. 15/357,936.
Office Action dated Aug. 10, 2017 for U.S. Appl. No. 15/357,850.
Office Action dated Nov. 2, 2017 for U.S. Appl. No. 15/700,007.
Office Action dated Nov. 24, 2017 for U.S. Appl. No. 15/359,972.
Office Action dated Nov. 24, 2017 for U.S. Appl. No. 15/679,857.
Office Action dated Dec. 6, 2017 for U.S. Appl. No. 15/592,178.
Potrykus (1991) "Gene Transfer to Plants: Assessment of Published Approaches and Results," Annu. Rev. Plant Physiol. Plant Mol. Bioi. 42:205-225.
Punt et al. (2002) "Filamentous fungi as cell factories for heterologous protein production," Trends Biotechnol. 20 (5):200-206.
Trueman (1995) "Heterologous Expression in Yeast," Methods Molecular Biology. 49:341-354.
Turner (1994) "Vectors for genetic manipulation," In; Martinelli, S.D.; Kinghorn J. R.: Eds. Aspergillus: 50 years on. Progress in industrial microbiology. vol. 29. Elsevier. Amsterdam, The Netherlands. pp. 641-666.
4d Pharma Plc: "Clinical Update—RNS—London Stock Exchange", Jul. 19, 2016.
"Amedei, A. et al. Multiple sclerosis: the role of cytokines in pathogenesis and in therapies. Int J Mol Sci. Oct. 19, 2012;13(10):13438-60. doi: 10.3390/ijms131013438.".
Anonymous: "4D pharma's Blautix for Irritable Bowel Syndrome shows positive impact—pharmaceutical daily news", Dec. 13, 2016.
Arenberg, et al., Interferon-y-inducible Protein 10 (IP-10) Is an Angiostatic Factor That Inhibits Human Non-small Cell Lung Cancer (NSCLC) Tumorigenesis and Spontaneous Metastases. 1996. J. Exp.Med. 184:981-92.
Atarashi et al., Th17 Cell Induction by Adhesion of Microbes to Intestinal Epithelial Cells. Cell, vol. 163, No. 2, Oct. 8, 2015. pp. 367-380.
Atarashi, et al., Treg induction by a rationally selected mixture of Clostridia strains from the human microbiota. Supplementary Information. Nature 500, 232-236 (Aug. 8, 2013) doi:10.1038/nature12331.
Atarashi, K. et al., Treg induction by a rationally selected mixture of Clostridia strains from the human microbiota. Nature. 2013; 500(7461):232-236.
Atlas, R. Handbook of Microbiological Media, Fourth Edition. CRC Press. 2010.
Ausubel, et al. Current Protocols in Molecular Biology. 1987. Supplement 30.
Ausubel et al., Short protocols in molecular biology. Fifth edition, 2002.
Azad, M.B. et al., Probiotic supplementation during pregnancy or infancy for the prevention of asthma and wheeze: systematic review and meta-analysis BMJ 2013; 347 :f6471.
Bagge, et al., Diversity of spore-forming bacteria in cattle manure, slaughterhouse waste and samples from biogas plants. Journal of applied microbiology. 2010;109: 1549-1565.
Balato, et al., Effects of adalimumab therapy in adult subjects with moderate-to-severe psoriasis on Th17 pathway. (2014) J Eur Acad Dermatol Venereol. 28(8):1016-24.
Banfield, J. & Murphy, K.R., Non-Th2, Late-onset, non-allergic asthma. Copd & Asthma for NPs, A peer-reviewed newsletter, Aug. 2016; 14: 8 Pages.
Beaucage, et al. Deoxynucleoside phosphoramidites—A new class of key intermediates for deoxypolynucleotide synthesis. Tetrahedron Letters, vol. 22, 1981, pp. 1859-1869.
Berger, S. Gideon guide to medically important bacteria. Gideon E-book Series. 2017 edition. 4 pages.

(56) References Cited

OTHER PUBLICATIONS

Bernalier et al. *Ruminococcus hydrogenotrophicus* sp. nov., a new H2/CO2-utilizing acetogenic bacterium isolated from human feces. 1996 Arch. Microbiol. 166 (3), 176-183.
Bertram, J. et al. Establishment of a cloned line of Lewis lung carcinoma cells adapted to cell culture. (1980) Cancer let. 11:63-73.
Birdi, K.S. Handbook of Surface and Colloid Chemistry, 2nd Edition. CRC Press. 1997.
Bottacini, et al., Comparative genomics of the Bifidobacterium brevetaxon. BMC Genomics, 2014; 15:170. DOI:10.1186/1471-1471-2164-15-170.
Brand et al., Collagen-induced arthritis, 2007; Protocol 2(5):1269-1275.
Brook, I., Clinical Review: Bacteremia caused by anaerobic bacteria in children. Critical Care 6(3): 7 pages (2002).
Bry et al. A model of host-microbial interactions in an open mammalian ecosystem. Science 273(5280):1380-1383 (1996).
Busing, K. et al., Effects of oral Enterococcus faecium strain DSM 10663 NCIMB 10415 on diarrhoea patterns and performance of sucking piglets. Benef Microbes. Mar. 2015;6(1):41-4. doi: 10.3920/BM2014.0008.
"Campeau, J.L. et al., Intestinal Epithelial Cells Modulate Antigen-Presenting Cell Responses to Bacterial DNA. Infectionand Immunity. Aug. 2012; 80(8): 2632-2644.".
Caruthers, et al. New chemical methods for synthesizing polynucleotides. Nucleic Acids Symp Ser. 1980;(7):215-23.
Caspi, P.R. Experimental autoimmune uveoretinitis in the rat and mouse. Curr Protoc Immunol. May 2003;Chapter 15:Unit 15.6. doi: 10.1002/0471142735.im1506s53.
Cekanaviciute, et al., Gut bacteria from multiple sclerosis patients modulate human T cells and exacerbate symptoms in mouse models. PNAS. Jun. 30, 2017; 1-6.
Charriot, et al., Future treatment for ashtma, Eur Respir Rev 2016; 25: 77-92.
Cheluvappa, R. et al., T helper type 17 pathway suppression by appendicitis and appendectomy protects against colitis. Clin Exp Immunol. Feb. 2014;175(2):316-22. doi: 10.1111/cei.12237.
Chen, S. et al., Live combined bacillus subtilis and enterococcus faecium ameliorate murine experimental colitis by immunosuppression. International journal of inflammation. 2014(878054). 7 Pages.
Chi, W. et al., IL-23 promotes CD4+ T cells to produce IL-17 in Vogt-Koyanagi-Harada disease. J Allergy Clin Immunol. May 2007;119(5):1218-24. Epub Mar. 1, 2007.
Chi, W. et al. Upregulated IL-23 and IL-17 in Behçet patients with active uveitis. Invest Ophthalmol Vis Sci. Jul. 2008;49(7):3058-64. doi: 10.1167/iovs.07-1390.
Chiu, et al., Monocolonization of germ-free mice with bacteroides fragilis protects against dectran sulfate sodium-induced acute colitis. Biomed Research International 2014. vol. 2014. Article ID 675786. 9 Pages.
Collins, M.D., et al., *Enterococcus avium* nom. rev., comb. nov.; *E. casseliflavus* nom. rev., comb. nov.; *E. durans* nom. rev., comb. nov.; *E. gallinarum* comb. nov.; and *E. malodoratus* sp. nov. (1984) Int J Syst Evol Microbiol. 34: 220-223.
Co-pending U.S. Appl. No. 15/906,988, filed Feb. 27, 2018.
Co-pending U.S. Appl. No. 15/915,885, filed Mar. 8, 2018.
Co-pending U.S. Appl. No. 15/915,889, filed Mar. 8, 2018.
Co-pending U.S. Appl. No. 15/916,167, filed Mar. 8, 2018.
Co-pending U.S. Appl. No. 15/916,202, filed Mar. 8, 2018.
Co-pending U.S. Appl. No. 15/916,205, filed Mar. 8, 2018.
Dahya V. et al., Clostridium ramosum Osteomyelitis in an immunocompetent patient after traumatic injury, Infectious Diseases in Clinical Practice 20150312 Lippincott Williams and Wilkins USA, vol. 23, No. 2, Mar. 12, 2015, pp. 102-104, XP009193312, ISSN: 1056-9103 the whole document.
Darlington, G.J., Liver Cell Lines. (1987) Meth Enzymol. 151:19-38.
Day, J.G. et al., Cryopreservation and Freeze-Drying Protocols. Springer. 2007. 2nd edition.
Demarche, et al., Detailed analysis of sputum and systemic inflammation in asthma phenotypes: are paucigranulocytic asthmatics really non-inflammatory?, BMC Pulmonary Medicine, 2016; (16)46: 1-13.
Distrutti, et al., Gut Microbiota role in irritable bowel syndrome: New therapeutic strategies. World Journal of Gastroenterology. Feb. 21, 2016; 22(7): p. 2219-2241, XP002769875.
Divyashri et al. Probiotic attributes, antioxidant, anti-inflammatory and neuromodulatory effects of Enterococcus faecium CFR 3003: in vitro and in vivo evidence. (2015) J Med Microbiol. doi: 10.1099/jmm.0.000184.
Duncan et al. (2002) "*Roseburia intestinal* is sp. nov., a novel saccharolytic, butyrate-producing bacterium from human faeces," International Journal System Evolutionary Microbiology. 52:1615-1620.
Duncan et al. (2006) "Proposal of *Roseburia faecis* sp. nov., *Roseburia hominis* sp. nov. and *Roseburia inulinivorans* sp. nov., based on isolates from human faeces," International Journal of Systematic and Evolutionary Microbiology. vol. 56, No. Pt 10, pp. 2437-2441.
Eckburg, PB. et al., Diversity of the human intestinal microbial flora.Science. Jun. 10, 2005;308(5728):1635-8. Epub Apr. 14, 2005.
Embl sequence AAO75294.1 (2003)—provided within the Office Action dated Feb. 16, 2018 in U.S. Appl. No. 15/631,952. 2 Pages.
Fabro, A. et al., The Th17 pathway in the peripheral lung microenvironment interacts with expression of collagen V in the late state of experimental pulmonary fibrosis. (2015) Immunobiology. 220(1):124-35.
Faghih, Z. et a., IL-17 and IL-4 Producing CD8+ T Cells in Tumor Draining Lymph Nodes of Breast Cancer Patients: Positive Association with Tumor Progression. (2013). Iranian Journal of Immunology. 10(4):193-204.
Fahy, J.V. Eosinophilic and neutrophilic inflammation in asthma: insights from clinical studies. Proc Am Thorac Soc. May 1, 2009;6(3):256-9. doi: 10.1513/pats.200808-087RM.
Farooq, P.D. et al., Pseudomembranous colitis, Disease-A-Month 2015 Mosby Inc. USA, vol. 61, No. 5, May 1, 2015, pp. 181-206, XP009193313, ISSN: 0011-5029 p. 195.
FDA Orphan Drug Designations. Total Orphan Drugs website. Aug. 2014. Available at http://www.orphan-drugs.org/2014/09/01/fda-orphandrug- designations-august-2014. Accessed on Apr. 13, 2016.
Fenner, et al., *Bacteroides massiliensis* sp. nov., isolated from blood culture of a newborn. International Journal of systematic and evolutionary microbiology, 2005. 55: 1335-1337.
Frank, D. et al., Molecular-phylogenetic characterization of microbial community imbalances in human inflammatory bowel diseases. 2007. PNAS. 104(34):13780-5.
Frick, et al., Identification of commensal bacterial strains that modulate Yersinia enterocolitica and Dextran sodium sulfate-induced inflammatory responses: implications for the development of probiotics. Infection and immunity, Jul. 2007;75(7):3490-3497.
GB Exam and search report dated Aug. 30, 2016 for GB Application No. 1520638.6.
GB Search and Exam report dated Mar. 31, 2016 for GB application 1510469.8.
GB Search and Exam report dated Mar. 31, 2016 for GB application 1510470.6.
GB Search and Exam report dated Apr. 15, 2016 for GB application 1510467.2.
GB Search and Exam report dated Apr. 20, 2016 for GB application 1510466.4.
GB Search and Exam report dated Apr. 20, 2016 for GB application 1510468.0.
GB Search and Exam report dated Aug. 30, 2016 for GB application No. 1520631.1.
GB Search and Exam report dated Nov. 17, 2016 for GB application 1520502.4.
GB Search and Exam report dated Sep. 13, 2016 for GB application 1520497.7.
Gennaro, A.R. "Quality Assurance and Control," from Remington: The Science and Practice of Pharmacy, 2000, Lippincott Williams & Wilkins, 20th ed., pp. 980-983.

(56) References Cited

OTHER PUBLICATIONS

Ghadimi, D. et al., Epigenetic imprinting by commensal probiotics inhibits the IL-23/IL-17 axis in an in vitro model of the intestinal mucosal immune system. JLB. 2012;92(4):895-911.
Goldin, B.R. et al., Clinical indications for probiotics: an overview. Clin Infect Dis. Feb. 1, 2008;46 Suppl 2:S96-100; discussion S144-51. doi: 10.1086/523333.
Greenspan et al., Defining epitopes: Its not as easy as it seems. Nature Biotechnology 7: 936-937, 1999.
Guide for the care and use of laboratory animals: 8th edition. The national academic press; 2011.
Haabeth et al. A model for cancer-suppressive inflammation. (2012) Oncolmmunology 1(1):1146-1152.
Hammerich, L. et al., Interleukins in chronic liver disease: lessons learned from experimental mouse models. (2014) Clin Exp Gastroenterol. 7:297-306.
Handbook of Experimental Immunology, vols. I IV (D.M. Weir and C.C. Blackwell, eds, 1986, Blackwell Scientific Publications).
Holdeman, et al., *Eubacterium contortum* (Prevot) comb. nov.: Emendation of description and designation of the type strain. International journal of systematic bacteriology. Oct. 1971;21(4):304-306.
Horn, et al., Synthesis of Oligonucleotides on Cellulose. Part II: Design and Synthetic Strategy to the Synthesis of 22 Oligodeoxynucleotides Coding for Gastric Inhibitory Polypeptide (GIP). 1980. Nuc Acids Res Symp Ser 225-232.
Horwell, et al., The 'peptoid' approach to the design of non-peptide, small molecule agonists and antagonists of neuropeptides. 1995. Trends Biotechnol. 13(4):132-134.
Hougee, et al., Oral treatment with probiotics reduces allergic symptoms in ovalbumin-sensitized mice:a bacterial strain comparative study. Int Arch Allergy Immunol. 2010; 151:107-117.
International Search Report dated Jan. 27, 2017 for International Application No. PCT/GB2016/053622.
International Search Report dated Feb. 17, 2017 for International Application No. PCT/GB2016/053676.
International Search Report dated Aug. 26, 2016 for International application No. PCT/GB2016/051774.
International Search Report dated Aug. 26, 2016 for International application No. PCT/GB2016/051776.
International Search Report dated Sep. 6, 2016 for International application No. PCT/GB2016/051768.
International Search Report dated Sep. 6, 2016 for International application No. PCT/GB2016/051773.
International Search Report dated Sep. 6, 2016for International application No. PCT/GB2016/051770.
International Search Report dated Feb. 2, 2017 for International application No. PCT/GB2016/053620.
International Search Report dated Mar. 6, 2017 for International Application No. PCT/GB2016/053677.
International search report with written opinion dated Feb. 26, 2018 for PCT/GB2017/053722.
International search report with written opinion dated Oct. 16, 2017 for PCT/GB2017/052076.
Ispirli, H. et al., Characterization of functional properties of Enterococcus faecium strains isolated from human gut.Can. J. Microbiol. 61: 861-870 (2015) dx.doi.org/10.1139/cjm-2015-0446.
Jawad, S. et al., Elevated serum levels of interleukin-17A in uveitis patients. Ocul Immunol Inflamm. Dec. 2013;21(6):434-9. doi: 10.3109/09273948.2013.815786. Epub Aug. 19, 2013.
Jiao et al., Blockade of Notch Signaling Ameliorates Murine Collagen-Induced Arthritis via Suppressing Th1 and Th17 Cell Responses. 2014; Pathology, 184(4):1085-1093.
Kailasapathy, K. Microencapsulation of Probiotic Bacteria:Technology and Potential Applications. Curr. Issues Intest. Microbiol. (2002) 3: 39-48.
Kanauchi, et al., Eubacterium limosum ameliorates experimental colitis and metabolite of microbe attenuates colonic inflammatory action with increase of mucosal integrity introduction, China World J Gastroenterol February, Jan. 1, 2006. pp. 1071-1077.
Kanauchi, et al., Eubacterium limosum (probiotic) and its metabolites showed anti-inflammatory effects and increased mucosal barrier function in colitis. S1912.
Kang, S. et al., Dysbiosis of fecal microbiota in Crohn's disease patients as revealed by a custom phylogenetic microarray.Inflamm Bowel Dis. Dec. 2010;16(12):2034-42. doi: 10.1002/ibd.21319.
Karaffova, et al., Interaction of TGF-B4 and IL-17 with IgA secretion in the intestine of chickens fed with E. faecium AL41 and challenged with S. Enteritidis. Research in Veterinary science. 2015:75-79.
Karin, M. Nuclear factor-kappaB in cancer development and progression. Nature. May 25, 2006;441(7092):431-6.
Kirsty Minton: Mucosal immunology: The ins and outs of gut inflammation, The journal of immunology, 4(2), Feb. 1, 2004: pp. 81-81, XP055252701.
Kitahara, M. et al., *Bacteroides plebeius* sp. nov. and *Bacteroides coprocola* sp. nov., isolated from human faeces. International journal of systematic and evolutionary microbiology. 2005; 55: 2143-2147.
Koenders, M.I. et al., Interleukin-17 Acts Independently of TNF-a under Arthritic Conditions. (2006) J. Immunol. 176:6262-6269.
Kogyo, S. Lactic Acid Bacteria, Intestinal Flora ad Health II; Physiological effects of heat-treated lactococcus "EF-2001" and application to food. Mar. 30, 2001 vol. 44, No. 6, pp. 35-39.
Kverka, M. et al., Oral administration of Parabacteroides distasonis antigens attenuates experimental murine colitis through modulation of immunity and microbiota composition. Clinical & Experimental Immunology. 2010; 163:250-259.
Laukova, A. et al. Benefits of Combinative Application of Probiotic, Enterocin M-Producing Strain Enterococcus Faecium AL41 and Eleutherococcus Senticosus in Rabbits. Folia Microbiol (Praha) 61 (2), 169-177. Sep. 9, 2015.
Lee, et al. Intestinal microbiota in pathophysiology and management of irritable bowel syndrome . 2014. World J Gastroenterol. 20(27): 8886-8897.
Lejeune, FJ. et al., Efficiency of Recombinant Human TNF in Human Cancer Therapy. (2006) Cancer Immun. 6:6.
Leslie, et al., Trehalose and sucrose protect both membranes and proteins in intact bacteria during drying. (1995) Appl. Environ. Microbiol. 61, 3592-3597.
Liu et al. Reclassification of Clostridium coccoides, Ruminococcus hansenii, Ruminococcus hydrogenotrophicus, Ruminococcus luti, Ruminococcus productus and Ruminococcus schinkii as *Blautia coccoides* gen. nov., comb. nov., *Blautia hansenii* comb. nov., *Blautia hydrogenotrophica* comb. nov., *Blautia luti* comb. nov., *Blautia producta* comb. nov., *Blautia schinkii* comb. nov. and description of *Blautia wexlerae* sp. nov., isolated from human faeces. 2008. Int J Syst Evol Microbiol 58,1896-1902.
Lodemann, U. et al., Effects of the Probiotic enterococcus faecium and pathogenic *Escherichia coli* strains in a pig and human epithelial intestinal cell model. Hindawi publishing corporation scientifica. 2015(235184) 10 pages.
Lopetuso et al. Commensal Clostridia: leading players in the maintenance of gut homeostasis. 2013. Gut Pathogens, 5: 23.
Luger, D. and Caspi, R.R., New perspectives on effector mechanisms in uveitis. (2008) Semin. Immunopathol. 30(2): 134-143.
Lyons, et al., Bacterial strain-specific induction of Foxp3 T regulatory cells is protective in murine allergy models. Clinical & Experimental Allergy. 2010; 40:811-819.
Machiels, K. A decrease of the butyrate-producing species Roseburia hominis and Faecalibacterium prausnitzii defines dysbiosis in patients with ulcerative colitis.Gut. Aug. 2014;63(8):1275-83. doi: 10.1136/gutjnl-2013-304833. Epub Sep. 10, 2013.
MacPherson, AJ. et al., IgA responses in the intestinal mucosa against pathogenic and non-pathogenic microorganisms. Oct. 2001. 3(12). 1021-1035.
MacPherson, AJ., et al., The functions of mucosal T cells in containing the indigenous commensal flora of the intestine.Cell Mol Life Sci. Dec. 2002;59(12):2088-96.
MacSharry et al., Immunomodulatory effects of feeding with bifidobacterium longum on allergen-induced lung inflammation in the mouse. Pulmonary pharmacology & Therapeutics. 2012; 25:325-334.

(56) References Cited

OTHER PUBLICATIONS

Maintaining Cultures for Biotechnology and Industry (1996) Jennie C. Hunter-Cevera, Academic Press.
Manni et al., A tale of two cytokines: IL-17 and IL-22 in asthma and infection. Expert Rev Respir Med. Feb. 2014 ; 8(1): 25-42. doi:10.1586/17476348.2014.854167.
Mansour et al. Isolation of Enterococcus faecium NM113, Enterococcus faecium NM213 and Lactobacillus casei NM512 as novel probiotics with immunomodulatory properties. (2014) Microbiol Immunol. 58(10):559-69.
Masco, L., et al., Identification of Bifidobacterium Species Using rep-PCR Fingerprinting. Systematic and Applied Microbiology 26(4):557-63 • Dec. 2003.
Maya, J.R. et al., Emerging Therapies for Noninfectious Uveitis: What May Be Coming to the Clinics. (2014) J. Ophthalmology. 310329.
Mazmanian et al. 'An immunomodulatory molecule of symbiotic bacteria directs maturation of the host immune system.' Cell. 2005, vol. 122, No. 1, pp. 107-118.
Miossec, P. et al. Targeting IL-17 and TH17 cells in chronic inflammation. Nat Rev Drug Discov. Oct. 2012;11(10):763-76. doi: 10.1038/nrd3794.
Mitropoulou, G. et al. Immobilization Technologies in Probiotic Food Production. (2013) Journal Nutr Metab. (2013) 716861.
Miyake, T. et al., Phylogenetic Analysis of the Genus Bifidobacterium and Related Genera Based on 16S rDNA Sequences. Microbiol. Immunol. 1998; 42(10):661-667.
Miyamoto-Shinohara et al. Survival of freeze-dried bacteria. J Gen Appl Microbiol 54(1):9-24 (2008).
Miyauchi, E., Control of multiple sclerosis by gut microbiota. Journal of clinical and experimental medicine. 2015. vol. 253 No. 5.2, pp. 445-450.
Molecular Biology Techniques: An Intensive Laboratory Course, (Ream et al., eds., 1998, Academic Press).
Monteleone, I. et al., Th17-related cytokines: new players in the control of chronic intestinal inflammation. (2011) BMC Medicine. 2011, 9:122.
Mucientes, A. et al., Specific association of IL17A genetic variants with panuveitis. (2015) Br J Ophthalmol. 99(4):566-70.
Mukai et al., SH3BP2 Gain-Of-Function Mutation Exacerbates Inflammation and Bone Loss in a Murine Collagen-Induced Arthritis Model, 2014 PLoS One 9(8): e105518.
Narushima, et al., Characterization of the 17 strains of regulatory T cell-inducing human-derived Clostridia. Gut Microbes Mar. 18, 2014; 5:3, 333-339.
Neish, A. S. et al., Prokaryotic Regulation of Epithelial Responses by Inhibition of IκB-αUbiquitination. Science 289, 1560 (2000).
Notice of allowance dated Sep. 1, 2017 for U.S. Appl. No. 15/357,850.
Notice of Allowance dated Nov. 22, 2017 for U.S. Appl. No. 15/359,988.
Nuala Moran: 'Microbial wealth', chemistry and industry, 78(6), Jun. 1, 2014, pp. 20-23, XP055252922.
Numasaki, M. et al., IL-17 Enhances the Net Angiogenic Activity and In Vivo Growth of Human Non-Small Cell Lung Cancer in SCID Mice through Promoting CXCR-2-Dependent Angiogenesis. (2005) J. Immunol. 175: 6177-6189.
Numasaki, M. et al., Interleukin-17 promotes angiogenesis and tumor growth. Blood. Apr. 1, 2003;101(7):2620-7. Epub Oct. 31, 2002.
Oladipo, et al., Bioprotective potential of bacteriocinogenic enterococcus gallinarum strains isolated from some Nigerian fermented foods, and of their bacteriocins. Polish Journal of Microbiology. 2014; 63(4): 415-422.
Overstreet et al. 'Dysbiosis Characterized by Reduced Abundance of Roseburia is Associated With Increased Severity of Colitis in IL-10-/-Mice'. Gastroenterology. 2011, vol. 140, No. 5, Suppl. 1, pp. S-696.
Pace et al. Macrophage activiation: Priming activity from a T-cell hybridoma is attributable to interferon. (1983) PNAS. 80:3782-6.
Parabacteroides distasonis (Eggerth and Gagnon) Sakamoto and Benno (ATCC 8503). Sep. 19, 2017. 2 Pages.
Park, S.K. et al., Blautia stercoris sp. nov., isolated from human faeces. International journal of systematic and evolutionary microbiology. 2012; 62(4): 776-779.
Patel., R. et al., Determination of 16S rRNA sequences of enterococci and application to species identification of nonmotile enterococcus gallinarum isolates. Journal of clinical microbiology, 1998; 36(11):3399-3407.
PCR (Introduction to Biotechniques Series), 2nd ed. (Newton & Graham eds., 1997, Springer Verlag).
PCT/EP2017/025038 Written Opinion of the International Preliminary Examining Authority dated Jan. 1, 2018.
Pearson, WR. An introduction to sequence similarity ("Homology") searching. Current protocols in bioinformatics/editoral board, Andreas D Baxevanis. 2013; 0 3:10.1002/0471250953.bi0301s42. doi:10.1002/0471250953.bi0301s42.
Robinson, et al. Inside information—The unique features of visceral sensation. 2008. Mol Interv, 8(5): 242-253.
Rockwell, S.C. et al., Characteristics of a Serially Transplanted Mouse Mammary Tumor and Its Tissue-Culture-Adapted Derivative. (1972) J Natl Cancer Inst. 49:735-49.
Rudinger et al., Characteristics of the amino acids as components of a peptide hormone sequence. Peptide Hormones. Biol. Council. Jun. 1976; 10 Pages.
Sagar, et al., Bifidobacterium breve and lactobacillus rhamnosus treatment is as effective as budesonide at reducing inflammation in a murine model for chronic asthma. Respiratory Research. 2014; 15(46):1-17.
Saiki, et al., Primer-directed enzymatic amplification of DNA with a thermostable DNA polymerase. 1988. Science, 239. pp. 487-491.
Sakamoto, M. et al., Reclassification of Bacteroides distasonis, Bacteroides goldsteinii and Bacteroides merdae as Parabacteroides distasonis gen. nov., comb. nov., Parabacteroides goldsteinii comb. nov. and Parabacteroides merdae comb. nov. International journal of systematic and evolutionary microbiology. 2006; 56: 1599-1605.
Salix Pharmaceuticals, Inc. FDA Highlights of Prescribing Information—XIFAXAN (rifaximin tablet). Revised Nov. 2015.
Sambrook, J.F. et al., Molecular Cloning: A Laboratory Manual, 3rd ed. Cold spring harbor laboratory press. 2001.
Scanlan PD., et al., Culture-independent analyses of temporal variation of the dominant fecal microbiota and targeted bacterial subgroups in Crohn's disease. J Clin Microbiol. Nov. 2006;44(11):3980-8. Epub Sep. 20, 2006.
Scher et al., Expansion of intestinal Prevotella copri correlates with enhanced susceptibility to arthritis. 2013; eLIFE 2, e01202, 20 Pages.
Schieck, M. et al., Genetic variation in TH17 pathway genes, childhood asthma, and total serum IgE levels.(2014) J Allergy Clin Immunol. 133(3):888-91.
Schleifer, K.H. et al., Transfer of Streptococcus faecalis and Streptococcus faecium to the Genus Enterococcus nom. rev. as Enterococcus faecalis comb. nov. and Enterococcus faecium comb. nov. Int J Syst Evol Microbiol, Jan. 1984 34: 31-34, doi:10.1099/00207713-34-1-31 .
Schmitz, S. et al., A prospective, randomized, blinded, placebo-controlled pilot study on the effect of Enterococcus faecium on clinical activity and intestinal gene expression in canine food-responsive chronic enteropathy. J Vet Intern Med. Mar.-Apr. 2015;29(2):533-43. doi: 10.1111/jvim.12563. Epub Mar. 16, 2015.
Schouten, et al., Cow milk allergy symptoms are reduced in mice fed dietary synbiotics during oral sensitization with whey. Nutritional Immunology. 2015; 139(7):1390-403.
Schwiertz, et al., Quantification of Different Eubacterium spp. in Human Fecal Samples with Species-Specific 16S rRNA-Targeted Oligonucleotide Probes. Applied and environmental biology, vol. 66, No. 1, Jan. 1, 2000; pp. 375-382.
Severijnen, et al., Chronic Arthritis Induced in Rats by Cell Wall Fragments of Eubacterium Species from the Human Intestinal Flora. Infection and Immunity, Feb. 1990; 58(2): p. 523-528.
Sgadari, C. et al., Interferon-inducible protein-10 identified as a mediator of tumor necrosis in vivo. (1996) PNAS. 93:13791-6.

(56) References Cited

OTHER PUBLICATIONS

Sgadari et al. Mig, the Monokine Induced by Interferon-g, Promotes Tumor Necrosis in Vivo. (1997) Blood. 89:2635-43.

Shabgah, A.G. et al., Interleukin-17 in human inflammatory diseases. Postepy Dermatol Alergol. Aug. 2014; 31(4): 256-261.

Simpson-Herren, L. et al., Kinetic parameters and growth curves for experimental tumor systems. Cancer Chemother Rep. Jun. 1970;54(3):143-74.

Sisson, G. et al., Randomised clinical trial: a liquid multi-strain probiotic vs. placebo in the irritable bowel syndrome—a 12 week double-blind study. Aliment Pharmacol Ther. 2014; 40: 51-62.

Sivieri, K. et al., Probiotic enterococcus faecium CRL 183 inhibit chemically induced colon cancer in male wistar rats. Eur Food Res Technol. 2008; 228:231-237.

Skolnick, et al. From genes to protein structure and function: novel applications of computational approaches in the genomic era. Trends Biotechnol. Jan. 2000;18(1):34-9. Review.

Smith, T.F. et al., Comparison of biosequences. (1981) Adv. Appl. Math. 2: 482-489.

Song et al., Impact of Schistosoma japonicum Infection on Collagen-Induced Arthritis in DBA/1 Mice: A Murine Model of Human Rheumatoid Arthritis. 2011; PLoS One 6, e23453, 10 pages.

Spor, A. et al., Unravelling the effects of the environment and host genotype on the gut microbiome. Nat Rev Microbiol. Apr. 2011;9(4):279-90. doi: 10.1038/nrmicro2540.

Stanton et al. (1983) "*Roseburia cecicola* gen. nov., sp. nov., a Motile, Obligately Anaerobic Bacterium from a Mouse Cecum," Int. J. Syst. Bacterial. 33:618-627.

Stoll et al., Altered microbiota associated with abnormal humoral immune responses to commensal organisms in enthesitis-related arthritis, 2014; Arthritis Res Ther. 16:486.

Strickertsson, J.A. et al., Enterococcus faecalis Infection and Reactive Oxygen Species Down-Regulates the miR-17-92 Cluster in Gastric Adenocarcinoma Cell Culture. Genes 2014, 5(3), 726-738.

Strobel, H.J. Basic laboratory culture methods for anaerobic bacteria. Methods Mol Biol. 2009;581:247-61. doi: 10.1007/978-1-60761-214-8_16.

Sun, D. et al., The role of Th17-associated cytokines in the pathogenesis of experimental autoimmune uveitis (EAU). (2015) Cytokine. 74(1):76-80.

Tamanai-Shacoori, et al., *Roseburia* spp.: a marker of health?. Future Microbiology Review 12(2), 157-170 (2017).

Tanaka, K. and Watanabe, K., In Vitro tebipenem activity against anaerobic bacteria. Japanese Journal of Chemotherapy. Mar. 2009. vol. 57 S-1.

Tap et al. Towards the human intestinal microbiota phylogenetic core. 2009. Environ Microbiol, 11(10):2574-84.

Tesmer, L.A. et al., Th17 cells in human disease. Immunol Rev. 2008;223:87-113.

Toomer, O. et al., Maternal and postnatal dietary probiotic supplementation enhances splenic regulatory T helper cell population and reduces peanut allergen-induced hypersensitivity responses in mice. Immunobiology. 209; 2014: 661-670.

Tsukinowa, et al., Fecal microbiota of a dugong (Dugong dugong) in captivity at Toba Aquarium. J. Gen. Appl. Microbiol., 54, 25-38 (2008).

Udayappan, et al., Oral treatment with Eubacterium hallii improves insulin sensitivity in db/db mice. Npj Biofilms and microbiomes, vol. 2, Jul. 6, 2016; p. 16009.

Udayappan et al., PS4-5. Administration of Eubacterium hallii improves insulin sensitivity and degree of liversteatosis in male db/db mice. Nederlands tijdschrift voor diabetologie, vol. 11, No. 4, Nov. 23, 2013.pp. 145.

U.S. Appl. No. 15/359,988 Notice of Allowance dated Mar. 2, 2018.

U.S. Appl. No. 15/359,988 Notice of Allowance dated Mar. 16, 2018.

U.S. Appl. No. 15/631,952 Office Action dated Feb. 16, 2018.

U.S. Appl. No. 15/679,857 Office Action dated Feb. 14, 2018.

U.S. Appl. No. 15/803,723 Notice of Allowance dated Feb. 13, 2018.

Van De Veerdonk, et al., The Anti-CD20 antibody rituximab reduces the Th17 cell response. Arthritis & Rheumatism. Jun. 2011; 63(6):1507-1516.

Vetrovsky, T. and Baldrian, P., The variability of the 16S rRNA gene in bacterial genomes and its consequences for bacterial community analyses. Plos One. Feb. 2013; 8(2): e57923.

Workman et al. Guidelines for the welfare and use of animals in cancer research (2010) Br. J. Cancer. 102:1555-77.

Wunderlich, P.F. et al., Double-blind report on the efficacy of lactic acid-producing enterococcus SF68 in the prevention of antibiotic-associated diarrhoea and in the treatment of acute diarrhoea. The journal of international medical research. 1989; 17: 333-338.

Xu, et al., the endogenous hydrogen sulfide producing enzyme cystathionine-i synthase contributes to visceral hypersensitivity in a rat model of irritable bowel syndrome. Molecular Pain, Biomed central, London, GB. Aug. 6, 2009; 5(1):p. 44.

Xu, J. et al., "Message from a human gut symbiont: sensitivity is a prerequisite for sharing", Trends in microbiology, 12(1), Jan. 1, 2004: pp. 21-28, XP055253932.

Yang, J. et al., Targeting Th17 cells in autoimmune diseases. Trends Pharmacol Sci. Oct. 2014;35(10):493-500. doi: 10.1016/j.tips.2014.07.006. Epub Aug. 14, 2014.

Ye, X. et al., The Role of IL-23/Th17 Pathway in Patients with Primary Immune Thrombocytopenia. (2015) PLoS One. 10(1):e0117704.

Yin, X. et al., Combined effect of five single nucleotide polymorphisms related to IL23/Th17 pathway in the risk of psoriasis. Immunogenetics. Mar. 2014;66(3):215-8. doi: 10.1007/s00251-013-0756-z. Epub Jan. 14, 2014.

Yurdusev, N. et al., Antagonistic Effect Exerted by Three Strictly Anaerobic Strains Against Various Strains of Clostridium Perfringens in Gnotobiotic Rodent Intestines. Can J Microbiol 33, 226-231 (1987).

Yurdusev, N. et al., InfectInunun 57,724-731 (1989).

Yutin, N. and Galperin, M.Y., A genomic update on clostridial phylogeny:Gram-negative spore formers and other misplaced clostridia. Environmental microbiology. 20136; 15(10): 2631-2641.

Zhang, B. et al., Oral administration of enterococcus faecalis FK-23 suppresses Th17 cell development and attenuates allergic airway responses in mice. International journal of molecular medicine. 2012; 30:248-254.

Zhang, B. et al., The Prevalence of Th17 Cells in Patients With Gastric Cancer. 2008. Biochem Biophys Res Commun 374 (3), 533-537.

Zhang, et al., The Activation of NF-κb in Infiltrated Mononuclear Cells Negatively Correlates with Treg Cell Frequency in Oral Lichen Planus. Inflammation. Aug. 2015;38(4):1683-9. doi: 10.1007/s10753-015-0145-x.

Zheng, B. et al., Bifidobacteriu breve attenuates murine dextran sodium sulfate-induced colitis and increases regulatory T cell responses. PLOS one. May 2014; 9(5).

Zhongyuan, T. et al., The inflammation regulation effects of enterococcus faecium HDRsEf1 on human enterocyte-like HT-29 cells. Animal cells and systems. Mar. 2016;20(2):70-76.

Zhou et al. Central and peripherial hypersensitivity in the irritable bowel syndrome. 2010. Pain. 148(3): 454-461.

Zhu, S. and Qian, Y., IL-17/IL-17 receptor system in autoimmune disease: mechanisms and therapeutic potential. Clinical Science (2012) 122, 487-511.

Zitomersky, N. et al., Characterization of Adherent Bacteroidales from Intestinal Biopsies of Children and Young Adults with Inflammatory Bowel Disease. PLOS one. 2013; 8(6).

Zitvogel, et al., Type I interferons in anticancer immunity. Nature Reviews. Jul. 2015:405-414.

U.S. Appl. No. 10/046,015, filed Aug. 14, 2018, Mulder, Imke Elisabeth et al.

U.S. Appl. No. 10/058,574, filed Aug. 28, 2018, Grant, George et al.

Christmann, et al., Human seroreactivity to gut microbiota antigens. J Allergy Clin Immunol 136(5):1378-1386; available online May 23, 2015.

(56) References Cited

OTHER PUBLICATIONS

Colin, et al., GIC-1001, A Clinical Stage, Orally Administered Colonic Analgesic Drug Proposed As a Cost-Effective Alternative to I.V. Sedation Used in Colonoscopy. Canadian Digestive Diseases Week, 2014; 2 pages.
Co-pending U.S. Appl. No. 16/022,207, filed Jun. 28, 2018.
Co-pending U.S. Appl. No. 16/022,256, filed Jun. 28, 2018.
Co-pending U.S. Appl. No. 16/022,484, filed Jun. 28, 2018.
Co-pending U.S. Appl. No. 16/022,577, filed Jun. 28, 2018.
Co-pending U.S. Appl. No. 16/031,024, filed Jul. 10, 2018.
Co-pending U.S. Appl. No. 16/040,356, filed Jul. 19, 2018.
Distrutti, et al., 5-Amino-2-hydroxybenzoic Acid 4-(5-Thioxo-5H-[1,2]dithiol-3yl)-phenyl Ester (ATB-429), a Hydrogen Sulfide-Releasing Derivative of Mesalamine, Exerts Antinociceptive Effects in a Model of Postinflammatory Hypersensitivity. The Journal of pharmacology and experimental therapeutics, 2006;319(1):447-458.
Farmer, et al., Gut pain & visceral hypersensitivity. British journal of pain, 2013;7(1):39-47.
Sun, et al., Exploring gut microbes in human health and disease: Pushing the envelope. Genes Dis. Dec. 2014; 1(2):132-139.doi:10.1016/j.gendis.2014.08.001.
U.S. Appl. No. 15/631,952 Office Action dated Jul. 19, 2018.
U.S. Appl. No. 15/679,857 Office Action dated Aug. 6, 2018.
U.S. Appl. No. 15/842,635 Office Action dated Aug. 27, 2018.
Van Tilburg, M. Can we treat visceral hypersensitivity in functional abdominal pain? Lancet Gastroenterolhepatol, 2017; 2 Pages.
Co-pending U.S. Appl. No. 15/969,543, filed May 2, 2018.
Ishikawa, et al., Effect of bifidobacteria to suppress Th17, Food Science and technology institute, 2008, 5 Pages.
U.S. Appl. No. 15/700,007 Office Action dated Jun. 1, 2018.
U.S. Appl. No. 15/357,936 Notice of Allowance dated Apr. 18, 2018.
U.S. Appl. No. 15/592,178 Notice of Allowance dated Apr. 12, 2018.
U.S. Appl. No. 15/916,202 Notice of Allowance dated Jun. 11, 2018.
U.S. Appl. No. 15/359,144 Office Action dated Apr. 10, 2018.
U.S. Appl. No. 15/359,972 Office Action dated Apr. 4, 2018.
U.S. Appl. No. 15/673,270 Office Action dated Apr. 10, 2018.
Van De Bogert, et al., Immunomodulatory properties of streptococcus and veillonella isolates from the human small intestine microbiota, PLOS One, Dec. 2014: 1-20, DOI:10.1371/journal.pone.0114277.

* cited by examiner

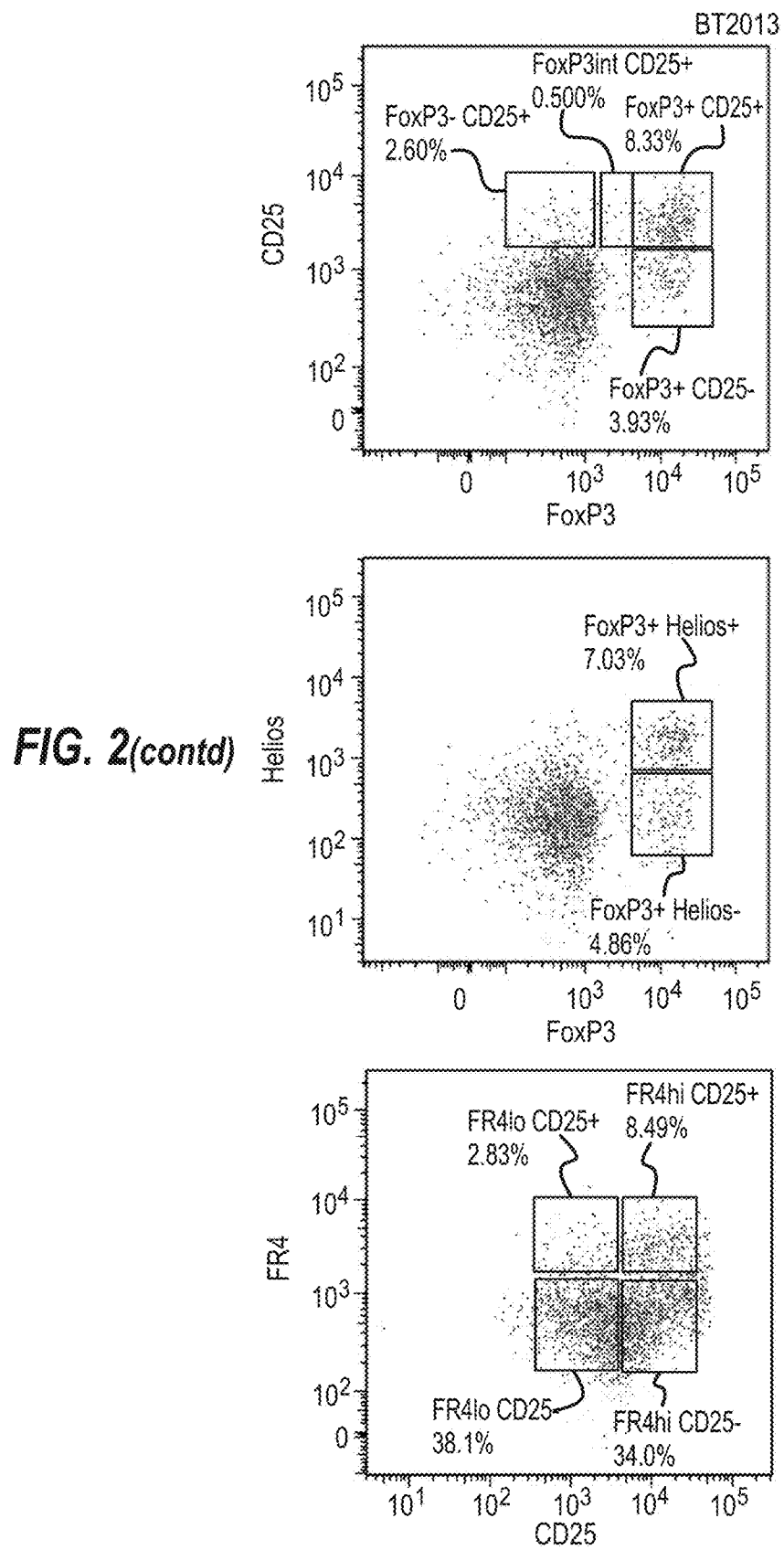
FIG. 2(contd)

| control vs BT2013 | * | P<0.05 |
| --- | --- | --- |
| control vs BT E1 | * | P<0.05 |
| control vs BTE2 | ** | P<0.01 |
| control vs DSS | *** | P<0.001 |
| BT2013 vs BTE1 | ns | P>0.05 |
| BT2013 vs BTE2 | ns | P>0.05 |
| BT2013 vs DSS | *** | P<0.001 |
| BT E1 vs BTE2 | ns | P>0.05 |
| BT E1 vs DSS | *** | P<0.001 |
| BTE2 vs DSS | *** | P<0.001 |

| | | |
|---|---|---|
| control vs BT2013 | ** | P<0.01 |
| control vs BT E1 | * | P<0.05 |
| control vs BTE2 | * | P<0.05 |
| control vs DSS | *** | P<0.001 |
| BT2013 vs BTE1 | ns | P>0.05 |
| BT2013 vs BTE2 | ns | P>0.05 |
| BT2013 vs DSS | ** | P<0.01 |
| BT E1 vs BTE2 | ns | P>0.05 |
| BT E1 vs DSS | ** | P<0.01 |
| BTE2 vs DSS | ** | P<0.01 |

COMPOSITION OF BACTEROIDES THETAIOTAOMICRON FOR IMMUNE MODULATION

CROSS-REFERENCE

This application is a continuation of International Application No. PCT/GB2015/054112, filed Dec. 22, 2015, which claims the benefit of Great Britain application No. 1423084.1, filed Dec. 23, 2014, which are hereby incorporated by reference in their entirety.

SEQUENCE LISTING

The instant application contains a Sequence Listing which has been submitted electronically in ASCII format and is hereby incorporated by reference in its entirety. Said ASCII copy, created on May 31, 2017, is named BT2013 sequence listings SEQ ID 1.txt and is 8,310,124 bytes in size.

FIELD OF THE INVENTION

The present invention relates to microorganisms that are able to positively modulate inflammatory disorders and which may be used in therapy or preventative medicine.

BACKGROUND OF THE INVENTION

*Bacteroides thetaiotaomicron* has potent anti-inflammatory effects in vitro and in vivo (Kelly et al. Commensal anaerobic gut bacteria attenuate inflammation by regulating nuclear-cytoplasmic shuttling of PPAR-gamma and RelA. Nat Immunol. 2004 January; 5(1):104-12). It modulates molecular signalling pathways of NF-κB (Kelly et al, Commensal anaerobic gut bacteria attenuate inflammation by regulating nuclear-cytoplasmic shuttling of PPAR-gamma and RelA. Nat Immunol. 2004 January; 5(1):104-12). In particular, it stops binding of the active component (RelA) of NF-κB to key genes in the nucleus, thereby preventing the activation of pro-inflammatory pathways (Kelly et al, Supra 2004). The full genome of *B. thetaiotaomicron* was sequenced and annotated by the Gordon Group (Washington University School of Medicine, USA) in 2003 [Xu et al, A genomic view of the human-*Bacteroides thetaiotaomicron* symbiosis. Science. 2003 Mar. 28; 299(5615):2074-6].

SUMMARY OF THE INVENTION

The present invention is based on the discovery of a strain of *Bacteroides thetaiotaomicron* (BT) that has surprising efficacy against inflammatory disorders. Accordingly the strain of BT is useful as a therapeutic or in preventative medicine against inflammatory disorders and/or autoimmune disorders and/or allergic disorders.

According to a first aspect of the invention, there is a *Bacteroides thetaiotaomicron* deposited as NCIMB Accession Number 42341, or a derivative thereof.

According to a second aspect of the invention, there is a nutritional supplement comprising a *Bacteroides thetaiotaomicron* as defined in claim 1, and a nutritionally acceptable excipient, carrier or diluent.

According to a third aspect of the invention, there is a feedstuff, food product, dietary supplement, or food additive comprising a *Bacteroides thetaiotaomicron* as defined in claim 1.

According to a fourth aspect of the invention, a *Bacteroides thetaiotaomicron* as defined in claim 1, a composition as defined in claim 2 or 3, a pharmaceutical composition as defined in claim 4 or 5, a nutritional supplement as defined in claim 6 or 7 or a feedstuff, a food product, a dietary supplement, or a food additive as defined in claim 8 or 9, for use in modulating the inflammation of a tissue or an organ in a subject.

According to a fifth aspect of the invention, a *Bacteroides thetaiotaomicron* as defined in claim 1, a composition as defined in claim 2 or 3, a pharmaceutical composition as defined in claim 4 or 5, a nutritional supplement as defined in claim 6 or 7 or a feedstuff, a food product, a dietary supplement, or a food additive as defined in claim 8 or 9, for use in the treatment and/or prevention of a disorder in a subject; wherein said disorder is an inflammatory disorder and/or an autoimmune disorder.

According to a sixth aspect of the invention, a *Bacteroides thetaiotaomicron* as defined in claim 1, a composition as defined in claim 2 or 3, a pharmaceutical composition as defined in claim 4 or 5, a nutritional supplement as defined in claim 6 or 7 or a feedstuff, a food product, a dietary supplement, or a food additive as defined in claim 8 or 9 for use in reducing disruption to the colon of a subject, preferably said subject has IBD.

According to a seventh aspect of the invention, a *Bacteroides thetaiotaomicron* as defined in claim 1, a composition as defined in claim 2 or 3, a pharmaceutical composition as defined in claim 4 or 5, a nutritional supplement as defined in claim 6 or 7 or a feedstuff, a food product, a dietary supplement, or a food additive as defined in claim 8 or 9 for use in reducing the expression of one or more pro-inflammatory genes in a cell or cells of a subject.

According to an eighth aspect of the invention, a *Bacteroides thetaiotaomicron* as defined in claim 1, a composition as defined in claim 2 or 3, a pharmaceutical composition as defined in claim 4 or 5, a nutritional supplement as defined in claim 6 or 7 or a feedstuff, a food product, a dietary supplement, or a food additive as defined in claim 8 or 9 for use in increasing the percentage of regulatory T cells (Tregs) in the alimentary canal or a section of the alimentary canal.

According to a ninth aspect of the invention, a process for producing a pharmaceutical composition according to claim 4 or 5, said process comprising admixing said *Bacteroides thetaiotaomicron* with a pharmaceutically acceptable excipient, carrier or diluent, wherein said *Bacteroides thetaiotaomicron* is optionally encapsulated in said process.

According to a tenth aspect of the invention, a method for modulating the inflammation of a tissue or an organ in a subject wherein said method comprises administering to the subject a *Bacteroides thetaiotaomicron* as defined in claim 1, a composition as defined in claim 2 or 3, a pharmaceutical composition as defined in claim 4 or 5, a nutritional supplement as defined in claim 6 or 7 or a feedstuff, a food product, a dietary supplement, or a food additive as defined in claim 8 or 9.

According to an eleventh aspect of the invention, a method for treating and/or preventing of an inflammatory disorder and/or an autoimmune disorder in a subject wherein said method comprises administering to the subject a *Bacteroides thetaiotaomicron* as defined in claim 1, a composition as defined in claim 2 or 3, a pharmaceutical composition as defined in claim 4 or 5, a nutritional supplement as defined in claim 6 or 7 or a feedstuff, a food product, a dietary supplement, or a food additive as defined in claim 8 or 9.

According to a twelfth aspect of the invention, a method for reducing disruption to the colon of a subject wherein said method comprises administering to the subject a *Bacteroides thetaiotaomicron* as defined in claim 1, a composition as defined in claim 2 or 3, a pharmaceutical composition as defined in claim 4 or 5, a nutritional supplement as defined in claim 6 or 7 or a feedstuff, a food product, a dietary supplement, or a food additive as defined in claim 8 or 9, preferably wherein the subject has IBD.

According to a thirteenth aspect of the invention, a method for reducing the expression of one or more pro-inflammatory genes in a cell or cells of a subject wherein said method comprises administering to the subject a *Bacteroides thetaiotaomicron* as defined in claim 1, a composition as defined in claim 2 or 3, a pharmaceutical composition as defined in claim 4 or 5, a nutritional supplement as defined in claim 6 or 7 or a feedstuff, a food product, a dietary supplement, or a food additive as defined in claim 8 or 9.

According to a fourteenth aspect of the invention, a method for increasing the percentage of Regulatory T cells (Tregs) in the alimentary canal or a section of the alimentary canal wherein said method comprises administering to the subject a *Bacteroides thetaiotaomicron* as defined in claim 1, a composition as defined in claim 2 or 3, a pharmaceutical composition as defined in claim 4 or 5, a nutritional supplement as defined in claim 6 or 7 or a feedstuff, a food product, a dietary supplement, or a food additive as defined in claim 8 or 9.

According to a fifteenth aspect of the invention, a *Bacteroides thetaiotaomicron* as defined in claim 1, a composition as defined in claim 2 or 3, a pharmaceutical composition as defined in claim 4 or 5, a nutritional supplement as defined in claim 6 or 7 or a feedstuff, a food product, a dietary supplement, or a food additive as defined in claim 8 or 9, for the manufacture of a medicament for modulating the inflammation of a tissue or an organ in a subject.

According to a sixteenth aspect of the invention, a *Bacteroides thetaiotaomicron* as defined in claim 1, a composition as defined in claim 2 or 3, a pharmaceutical composition as defined in claim 4 or 5, a nutritional supplement as defined in claim 6 or 7 or a feedstuff, a food product, a dietary supplement, or a food additive as defined in claim 8 or 9, for the manufacture of a medicament for the treatment and/or prevention of an inflammatory disorder and/or an autoimmune disorder in a subject.

According to a seventeenth aspect of the invention, a *Bacteroides thetaiotaomicron* as defined in claim 1, a composition as defined in claim 2 or 3, a pharmaceutical composition as defined in claim 4 or 5, a nutritional supplement as defined in claim 6 or 7 or a feedstuff, a food product, a dietary supplement, or a food additive as defined in claim 8 or 9 for the manufacture of a medicament for reducing disruption to the colon of a subject, preferably wherein the subject has IBD.

According to an eighteenth aspect of the invention, a *Bacteroides thetaiotaomicron* as defined in claim 1, a composition as defined in claim 2 or 3, a pharmaceutical composition as defined in claim 4 or 5, a nutritional supplement as defined in claim 6 or 7 or a feedstuff, a food product, a dietary supplement, or a food additive as defined in claim 8 or 9 for the manufacture of a medicament for reducing the expression of one or more pro-inflammatory genes in a cell or cells of a subject.

According to a nineteenth aspect of the invention, a *Bacteroides thetaiotaomicron* as defined in claim 1, a composition as defined in claim 2 or 3, a pharmaceutical composition as defined in claim 4 or 5, a nutritional supplement as defined in claim 6 or 7 or a feedstuff, a food product, a dietary supplement, or a food additive as defined in claim 8 or 9 for the manufacture of a medicament for increasing the percentage of Regulatory T cells (Tregs) in the alimentary canal or a section of the alimentary canal.

BRIEF DESCRIPTION OF THE FIGURES

The invention is described with reference to the accompanying figures, wherein.

DETAILED DESCRIPTION OF THE INVENTION

Figure 1:
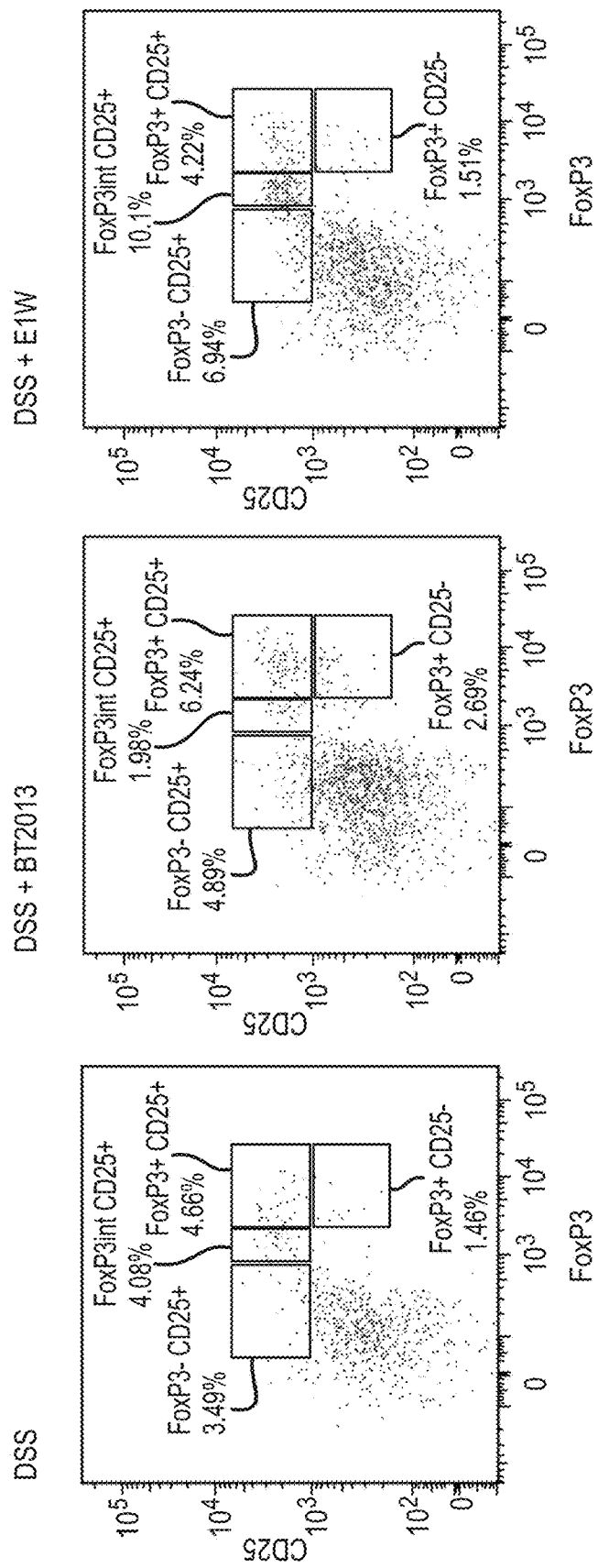
FIG. 1 illustrates the attenuation of colitis via expansion of Treg cells with *B. thetaiotaomicron* strain BT2013 in a DSS induced colitis model.
Figure 1:
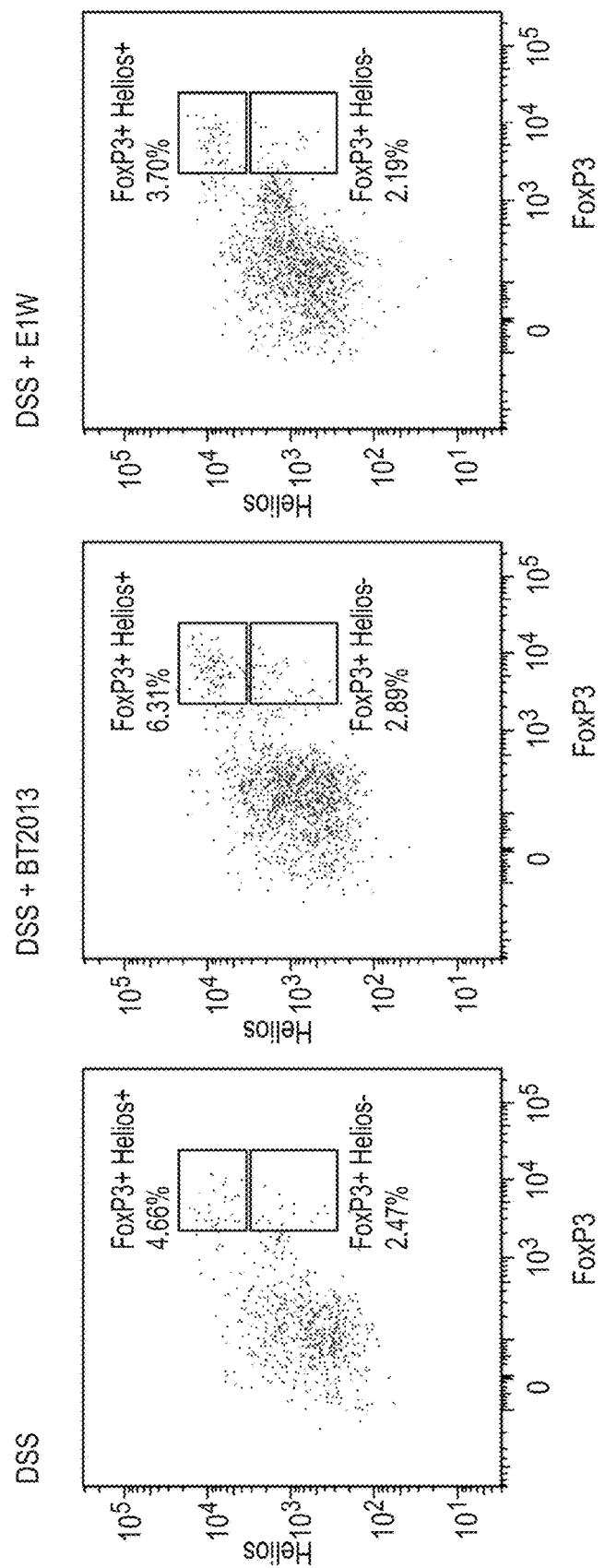
Figure 1:
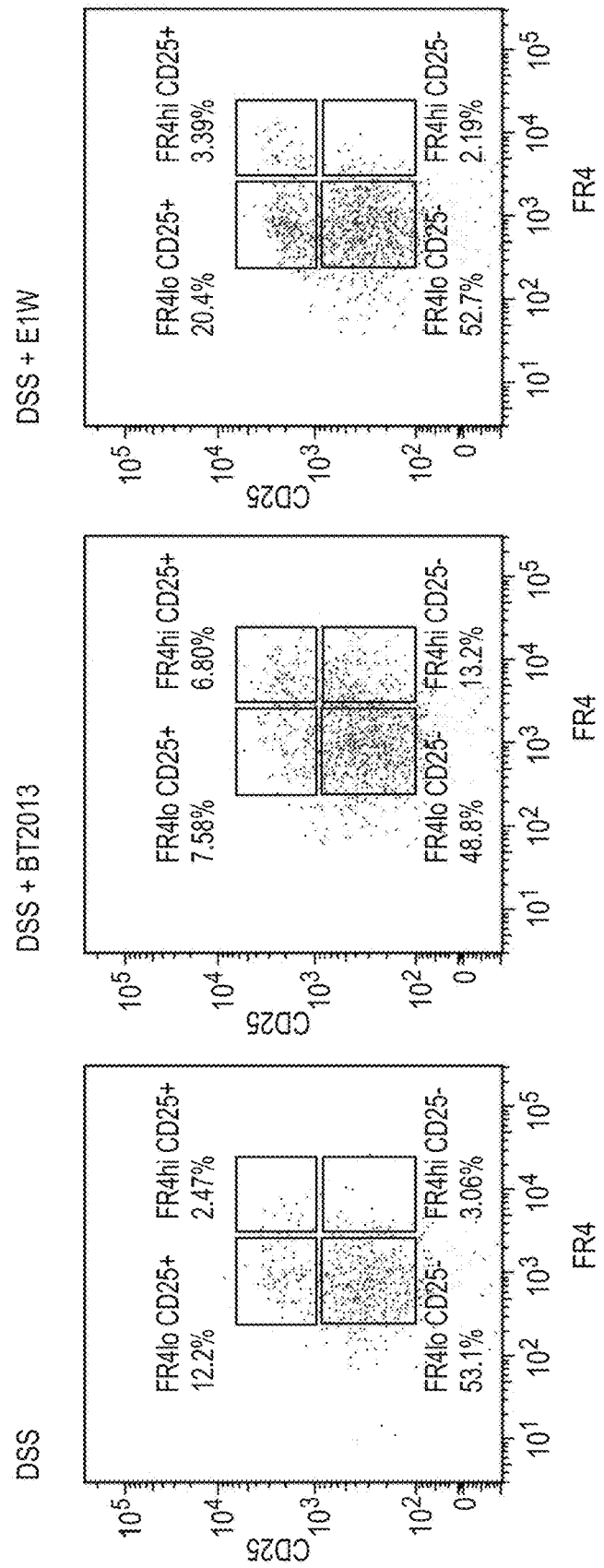

The present invention is based on the finding that BT strain BT2013 has more potent anti-inflammatory effects compared to control BT strains.

BT strain BT2013 has been deposited under Accession number 42341 on 3 Dec. 2014 at National Collections of Industrial, Food and Marine Bacteria (NCIMB) at NCIMB Ltd, Ferguson Building, Craibstone Estate, Bucksburn, Aberdeen, UK, AB21 9YA. The deposit was made under the terms of the Budapest Treaty. Maintenance of a viable culture is assured for 30 years from the date of the deposits. All restrictions on the availability to the public of the deposited microorganism will be irrevocably removed upon the granting of a patent for this application. The deposit was made by GT Biologics Ltd. (Life Sciences Innovation Building, Aberdeen, AB25 2ZS, Scotland). GT Biologics Ltd. has subsequently changed its name to 4D Pharma Research Limited.

Derivative

The present invention encompasses derivatives of the deposited strain. The term "derivative" includes daughter strains (progeny) or stains cultured (sub-cloned) from the original but modified in some way (including at the genetic level), without altering negatively the biological activity, i.e. the derivative strain will have at least the same immune modulatory activity as the original BT2013 strain.

Biotypes

A genome sequence for strain BT2013 is provided in SEQ ID NO:1.

Bacterial strains that are biotypes of the bacterium deposited under accession number NCIMB 42341 are also expected to be effective for treating or preventing inflammatory disorders and/or autoimmune disorders and/or allergic disorders. A biotype is a closely related strain that has the same or very similar physiological and biochemical characteristics.

In certain embodiments, the bacterial strain for use in the invention has a 16s rRNA sequence that is at least 95%, 96%, 97%, 98%, 99%, 99.5% or 99.9% identical to the 16s rRNA sequence of the bacterium deposited under accession number NCIMB 42341.

Alternatively, strains that are biotypes of the bacterium deposited under accession number NCIMB 42341 and that are suitable for use in the invention may be identified by sequencing other nucleotide sequences for the bacterium deposited under accession number NCIMB 42341. For example substantially the whole genome may be sequenced and a biotype strain for use in the invention may have at least 95%, 96%, 97%, 98%, 99%, 99.5% or 99.9% sequence identity across at least 80% of its whole genome (e.g. across at least 85%, 90%, 95% or 99%, or across its whole genome). Other suitable sequences for use in identifying biotype strains may include hsp60 or repetitive sequences such as BOX, ERIC, (GTG)$_5$, or REP (Masco et al. (2003) Systematic and Applied Microbiology, 26:557-563). Biotype strains may have sequences with at least 95%, 96%, 97%, 98%, 99%, 99.5% or 99.9% A sequence identity to the corresponding sequence of the bacterium deposited under accession number NCIMB 42341.

In certain embodiments, the bacterial strain for use in the invention has a genome with sequence identity to SEQ ID NO:1. In preferred embodiments, the bacterial strain for use in the invention has a genome with at least 90% sequence identity (e.g. at least 92%, 94%, 95%, 96%, 97%, 98%, 99% A or 100% sequence identity) to SEQ ID NO:1 across at least 60% (e.g. at least 65%, 70%, 75%, 80%, 85%, 95%, 96%, 97%, 98%, 99% A or 100%) of SEQ ID NO:1. For example, the bacterial strain for use in the invention may have a genome with at least 90% sequence identity to SEQ ID NO:1 across 70% of SEQ ID NO:1, or at least 90% sequence identity to SEQ ID NO:1 across 80% of SEQ ID NO:1, or at least 90% sequence identity to SEQ ID NO:1 across 90% of SEQ ID NO:1, or at least 90% sequence identity to SEQ ID NO:1 across 100% of SEQ ID NO:1, or at least 95% sequence identity to SEQ ID NO:1 across 70% of SEQ ID NO:1, or at least 95% sequence identity to SEQ ID NO:1 across 80% of SEQ ID NO:1, or at least 95% sequence identity to SEQ ID NO:1 across 90% of SEQ ID NO:1, or at least 95% sequence identity to SEQ ID NO:1 across 100% of SEQ ID NO:1, or at least 98% sequence identity to SEQ ID NO:1 across 70% of SEQ ID NO:1, or at least 98% sequence identity to SEQ ID NO:1 across 80% of SEQ ID NO:1, or at least 98% sequence identity to SEQ ID NO:1 across 90% of SEQ ID NO:1, or at least 98% sequence identity to SEQ ID NO:1 across 100% of SEQ ID NO:1.

Alternatively, strains that are biotypes of the bacterium deposited under accession number NCIMB 42341 and that are suitable for use in the invention may be identified by using the accession number NCIMB 42341 deposit and restriction fragment analysis and/or PCR analysis, for example by using fluorescent amplified fragment length polymorphism (FAFLP) and repetitive DNA element (rep)-PCR fingerprinting, or protein profiling, or partial 16S or 23s rDNA sequencing.

In certain embodiments, strains that are biotypes of the bacterium deposited under accession number NCIMB 42341 and that are suitable for use in the invention are strains that provide the same pattern as the bacterium deposited under accession number NCIMB 42341 when analysed by amplified ribosomal DNA restriction analysis (ARDRA), for example when using Sau3AI restriction enzyme (for exemplary methods and guidance see, for example, Srůtková et al. (2011) J. Microbiol. Methods, 87(1):10-6). Alternatively, biotype strains are identified as strains that have the same carbohydrate fermentation patterns as the bacterium deposited under accession number NCIMB 42341.

Bacterial strains that are biotypes of the bacterium deposited under accession number NCIMB 42341 and that are useful in the compositions and methods of the invention may be identified using any appropriate method or strategy. For example, bacterial strains that have similar growth patterns, metabolic type and/or surface antigens to the bacterium deposited under accession number NCIMB 42341 may be useful in the invention. A biotype strain will have comparable immune modulatory activity to the NCIMB 42341 strain. For example, a biotype strain will elicit comparable effects on the DSS-induced colitis models and comparable effects on Treg levels, MPO enzymatic activity, inflammation-associated gene expression and colon histopathology to the effects shown in the Functional Assays, which may be identified by using the protocols described in the Functional Assays.

Disorders

The *Bacteroides thetaiotaomicron* strain BT2013 may be used for the treatment and/or prevention of a disorder in a subject, wherein said disorder is an inflammatory disorder and/or an autoimmune disorder.

In one embodiment, the disorder affects the alimentary canal, a section of the alimentary canal, the liver, liver cells, immune cells, epithelial cells, epidermal cells, neuronal cells, endothelial cells, fibroblasts, the pancreas, and/or pancreatic cells (such as the islets of Langerhans).

Examples of sections (i.e. parts) of the alimentary canal include the oesophagus, the stomach and the intestine (such as the small intestine (e.g. the duodenum, the jejunum and the ileum) and/or the large intestine (e.g. the caecum, ascending colon, transverse colon, descending colon, and sigmoid colon)).

Examples of epithelial cells include intestinal epithelial cells. Examples of immune cells include dendritic cells, monocytes/macrophages, Tcells and neutrophils.

In one embodiment, the disorder is selected from the group consisting of:

1. Organ associated disorders such as irritable bowel syndrome (IBS), inflammatory bowel disease including Crohn's disease and ulcerative colitis, necrotising enterocolitis, pouchitis, coeliac disease, multiple sclerosis (brain), type I diabetes, Goodpasture's syndrome, Hashimoto thyroiditis, chronic active hepatitis, cardiomyopathy, uveitis and rhinitis.

2. Systemic disorders such as rheumatoid arthritis, systemic lupus erythematosus, scleroderma, psoriasis, atopic dermatitis, vitiligo, multiple sclerosis, alopecia areata, sarcoidosis, polymyositis and combinations thereof.

In one aspect, the disorder affects the intestine.

In one aspect, the disorder is an inflammatory disorder. For example, the disorder is an inflammatory bowel disorder (IBD) such as Crohn's disease.

In one aspect, the disorder is an autoimmune disorder. For example, the autoimmune disorder is selected from the group consisting of ulcerative colitis, pouchitis, rheumatoid arthritis, psoriasis, multiple sclerosis, type I diabetes, allergies (including coeliac disease), atopic dermatitis and rhinitis.

Subject

In one embodiment, the subject is a monogastric animal.

Examples of monogastric animals include poultry, humans, rats, pigs, dogs, cats, horses and rabbits.

In another embodiment, the subject is a mammal such as a monogastric mammal.

Examples of monogastric mammals include omnivores (such as humans, rats, and pigs), carnivores (such as dogs and cats), and herbivores (such as horses and rabbits).

Preferably, the subject is a human.

In one aspect, the subject has a disorder is selected from the group consisting of inflammatory bowel disorder (IBD), colitis, rheumatoid arthritis, psoriasis, multiple sclerosis, type I diabetes, coeliac disease, atopic dermatitis, rhinitis, irritable bowel syndrome (IBS), ulcerative colitis, pouchitis, Crohn's disease, functional dyspepsia, atopic diseases, necrotising enterocolitis, non alcoholic fatty liver disease, gastrointestinal infection and combinations thereof. For example, the subject has IBD.

Modulation/Regulation

The terms "modulation" and "regulation" may be used interchangeably herein.

In one embodiment The *B. thetaiotaomicron* strain BT2013 is used to modulate the inflammation of a cell, a tissue or an organ in a subject.

In one embodiment, the term "modulation" refers to an increase and/or induction and/or promotion and/or activation. In an alternative embodiment, the term "modulation" refers to a decrease and/or reduction and/or inhibition.

In one embodiment, the term "regulation" refers to an upregulation. In an alternative embodiment, the term "regulation" refers to a downregulation.

In one embodiment, the *B. thetaiotaomicron* strain BT2013 as described herein reduces the inflammation of a cell, a tissue or an organ. For example, inflammation of the alimentary canal, a section (i.e. part) of the alimentary canal (such as the intestine), the liver, liver cells, epithelial cells, epidermal cells, neuronal cells, endothelial cells, fibroblasts, the pancreas, and/or pancreatic cells (such as the islets of Langerhans) is reduced.

In one example, inflammation of the alimentary canal or part thereof (such as the intestine) is reduced.

In another example, inflammation by immune cells of the tissue or the organ is reduced.

In another example, inflammation by epithelial cells of the tissue or the organ is reduced.

The term "inflammation" as used herein refers to one or more of the following: redness, swelling, pain, tenderness, heat, and disturbed function of a cell, a tissue or organ due to an inflammatory process triggered by over-reaction of the immune system.

In one embodiment, the numbers of cells which are inflamed in a subject is at least 10%, 20%, 30%, 40% or 50% lower after administration of the polypeptide or polynucleotide or host cell as described herein when compared to the numbers of cells which are inflamed in a subject before the strain BT2013 as described herein is administered to the subject.

In one embodiment, the amount of a tissue or organ which is inflamed in a subject is at least 10%, 20%, 30%, 40% or 50% lower after administration of strain BT2013 when compared to the amount of tissue or organ which is inflamed in a subject before the strain BT2013 is administered to the subject.

In one embodiment, the strain BT2013 reduces the inflammation by epithelial cells of the tissue or the organ.

For example, the epithelial cells are epithelial cells of the alimentary canal or part thereof (such as the intestine).

Without wishing to be bound by theory, the strain BT2013 increases the production of T cells (such as regulatory T cells which may also be referred to as Tregs) in a subject. This increase in Treg numbers may combat the effects of other effector T cells (also referred to as Teffs), such as Th1, Th17 and Th2 which drive inflammation, autoimmunity and allergic/atopic conditions. In Crohn's disease and ulcerative colitis the Teff/Treg cell balance is lost.

In one embodiment, the production of T cells in a subject is increased such that there are at least 10%, 20%, 30%, 40% or 50% more T cells, or greater than 100% more T cells after administration of the polypeptide or polynucleotide or host cell as described herein when compared to the number of T cells in the subject before the strain BT2013 is administered to the subject.

Intestine Barrier Integrity

In one embodiment, the strain BT2013 is used to improve intestine barrier integrity in a subject.

The term "improving intestine barrier integrity" as used herein refers to a reduction in the numbers and/or types of microorganisms which spread from the intestine into other cells in a subject after administration of the strain BT2013 when compared to the numbers and/or types of microorganisms which spread from the intestine into other cells in a subject before administration of the strain BT2013 as described herein.

In one embodiment, the numbers of microorganisms which spread from the intestine into other cells in a subject are at least 10%, 20%, 30%, 40% or 50% lower after administration of the strain BT2013 when compared to the numbers of microorganisms which spread from the intestine into other cells in a subject administration.

In one embodiment, there are at least 5%, 10%, 15% or 20% fewer types of microorganisms which spread from the intestine into other cells in a subject after administration of the strain BT2013 when compared to the types of microorganisms which spread from the intestine into other cells in a subject before the administration.

Intestine Disruption

In one embodiment strain BT2013, is used to reduce disruption to the intestine (e.g. large intestine) of a subject (such as a subject with IBD).

The term "disruption to the intestine of a subject" as used herein refers to an affect on the integrity of the mucosal epithelium and/or an affect on the number of goblet cells in the epithelium and/or an affect on the number of immune cells infiltrating the lamina propria.

In one embodiment, strain BT2013 reduces or prevents disruption to the integrity of the mucosal epithelium and/or reduces or prevents a reduction in the number of goblet cells in the epithelium and/or reduces or prevents the infiltration of immune cells into the lamina propria.

In one embodiment, a reduction in disruption to the integrity of the mucosal epithelium is a reduction of at least 5%, 10%, 15% or 20% in the numbers of bacteria crossing from the intestinal lumen into intestinal cells after administration of strain BT2013 when compared to the numbers of bacteria crossing from the intestinal lumen into intestinal cells in a subject before administration.

In one embodiment, a reduction in the number of goblet cells in the epithelium is a reduction of at least 2%, 5%, 10%, 15% or 20% in the numbers of goblet cells in the epithelium of a subject after administration of strain BT2013 when compared to the number of goblet cells in the epithelium of a subject before administration.

In one embodiment, the reduction in the infiltration of immune cells into the lamina propria is such that over a fixed time period (such as 24 hours) there is a reduction of at least 5%, 10%, 15%, 20% or 30% in the numbers of immune cells (e.g. T cells) crossing into lamina propria cells after administration of strain BT2013 when compared to the numbers of immune cells (e.g. T cells) crossing into the lamina propria in a subject before administration.

Pro-Inflammatory Genes and Barrier Integrity Genes

In one embodiment, strain BT2013 is used to regulate the expression of one or more pro-inflammatory genes and/or one or more barrier integrity genes in a cell or cells of a subject.

In one embodiment, the term "regulate" refers to an upregulation in the expression of one or more pro-inflammatory genes. In an alternative embodiment, the term "regulate" refers to a downregulation in the expression of one or more pro-inflammatory genes.

In one embodiment, strain BT2013 downregulates the expression of one or more pro-inflammatory genes in a cell or cells of a subject.

The term "pro-inflammatory gene" as used herein refers to a gene which, when expressed, promotes inflammation. Examples of pro-inflammatory genes include genes encoding but not limited to IL1-β, IL4, IL5, IL6, IL8, IL12, IL13, IL17, IL21, IL22, IL23, IL27, IFN, CCL2, CCL3, CCL5, CCL20, CXCL5, CXCL10, CXCL12, CXCL13, and TNF-α.

In one embodiment, the pro-inflammatory gene is selected from the group consisting of IL1-β, IL6 and IL8.

In one embodiment, the expression level (e.g. mRNA level) of one or more pro-inflammatory genes is decreased (i.e. downregulated) such that the level is at least 10%, 20%, 30%, 40% or 50% lower after administration of the strain BT2013 when compared to the level in the subject before administration.

The term "barrier integrity genes" as used herein refers to a gene which, when expressed, has a role in the function of the barrier of the intestine such as the repair of the barrier and the prevention of microorganisms crossing the barrier. Examples of barrier integrity genes include genes encoding Retnlg|Retnlb, Si, Defa24, Hsd11b2, Hsd17b2, and Nr1d1|Thra.

In one embodiment, the term "regulate" refers to an upregulation in the expression of one or more barrier integrity genes. In an alternative embodiment, the term "regulate" refers to a downregulation in the expression of one or more barrier integrity genes.

In one embodiment, strain BT2013 upregulates the expression of barrier integrity genes in a cell or cells of a subject In one embodiment, the barrier integrity gene is selected from the group consisting of Retnlg|Retnlb, Si, Defa24, Hsd11b2, Hsd17b2, and Nr1d1|Thra.

In one embodiment, the expression level (e.g. mRNA level) of one or more barrier integrity genes is increased (i.e. upregulated) such that the level is at least 10%, 20%, 30%, 40% or 50% higher after administration of strain BT2013 when compared to the level in the subject before administration.

Alimentary Canal

Parts of the alimentary canal include the oesophagus, the stomach and the intestine (such as the small intestine (e.g. the duodenum, the jejunum and the ileum) and/or the large intestine (e.g. the caecum, ascending colon, transverse colon, descending colon, and sigmoid colon)).

Herein, the term "large intestine" may be used interchangeably with the term "colon".

In one embodiment, strain BT2013 is used for improving alimentary canal health in a subject.

The term "improving alimentary canal health" as used herein refers to reducing the level of inflammation in the alimentary canal or part thereof and/or improving intestinal microbiota.

In one embodiment, the level of inflammation in the alimentary canal is at least 10%, 20%, 30%, 40% or 50% lower after administration of strain BT2013 when compared to the level of inflammation in the alimentary canal of a subject before administration.

In one embodiment, strain BT2013 is used for improving intestinal microbiota in a subject.

The term "intestinal microbiota" as used herein refers to microorganisms that live in the digestive tract of the host animals. These microorganisms perform a wide variety of metabolic, structural, protective and other beneficiary functions.

As used herein, the term "improving intestinal microbiota" refers to increasing the number and/or type of desirable microorganisms present in the intestine of a subject (e.g. the host), and/or increasing the activity of said desirable microorganisms in terms of their metabolic, structural, protective and other beneficiary functions. The term "improving intestinal microbiota" may also refer to decreasing the number and/or type of undesirable microorganisms present in the intestine of a subject (e.g. the host), and/or decreasing the activity of said undesirable microorganisms in terms of their metabolic, structural, protective and other beneficiary functions.

Microorganisms which are desirable in the intestine of a host are those microorganisms which have a protective and beneficiary function. Firmicutes and bacteroidetes bacteria are examples of desirable microorganisms in the intestine of a host.

Microorganisms which are undesirable in the intestine of a host are those microorganisms which can interfere with the metabolic, structural, protective and other beneficiary functions of desirable microorganisms in the intestine have a protective and beneficiary function. In addition or alternatively, undesirable microorganisms are those which cause, for example, inflammation and/or diarrhea. *E. coli* is an example of an undesirable microorganism in the intestine of a host.

For example, a change in the microbiota balance between desirable microorganism (such as firmicutes and bacteroidetes bacteria) and undesirable microorganisms (such as *E. coli*: ETEC, EPEC, EIEC, EHEC and EAEC) within the intestine may occur in subjects with inflammatory bowel disease (IBD) once strain BT2013 has been administered to the subject.

In one embodiment, the number of desirable microorganisms (such as firmicutes and bacteroidetes bacteria) present in the intestine of a subject (e.g. the host), is increased such that the number of microorganisms is at least 10%, 20%, 30%, 40% or 50% higher, or greater than 100% higher after administration of the strain BT2013 compared to the level in the subject before administration. In addition, or alternatively, the types of desirable microorganisms (such as firmicutes and bacteroidetes) present in the intestine of a subject (e.g. the host), are increased such that there are at least 2%, 5%, 10%, or 15% more types of microorganisms after administration of strain BT2013 when compared to the types in the subject before administration.

In one embodiment, the number of undesirable microorganisms (such as *E. coli* ETEC, EPEC, EIEC, EHEC and EAEC) present in the intestine of a subject (e.g. the host), is decreased such that the number of microorganisms is at least 10%, 20%, 30%, 40% or 50% lower after administration strain BT2013 when compared to the level in the subject before administration. In addition, or alternatively, the types of undesirable microorganisms (such as *E. coli* ETEC, EPEC, EIEC, EHEC and EAEC) present in the intestine of a subject (e.g. the host), are decreased such that there are at least 1%, 2%, 5%, or 10%, fewer types of undesirable microorganisms after administration of strain BT2013 when compared to the types in the subject before administration.

Encapsulation

In one embodiment, the *B. thetaiotaomicron* strain BT2013 is encapsulated.

In a further embodiment, a pharmaceutical composition comprising the strain BT2013 is encapsulated.

In another embodiment, a nutritional supplement comprising the strain BT2013 is encapsulated.

In a further embodiment, a feedstuff, food product, dietary supplement, or food additive as described herein is encapsulated.

The term "encapsulated" as used herein refers to a means for protecting the strain BT2013 from an incompatible environment by physical separation so that it can be delivered to the target site (e.g. the intestine) without degradation or significant degradation in order that the strain BT2013 can have an effect on the target site. An example is an enteric coated capsule or an enterically-resistant capsule.

Even when the objective of the encapsulation is the isolation of the strain from its surroundings, the protective coating or shell must be ruptured at the time of desired action. The rupturing of the protective coating or shell is typically brought about through the application of chemical and physical stimuli such as pressure, enzyme attack, chemical reaction and physical disintegration.

For example, encapsulation ensures that the strain can be ingested so that the microorganisms can be delivered to the target site (e.g. the intestine) in an amount which is effective to produce an effect at the target site.

Pharmaceutical Composition

In one embodiment, a pharmaceutical composition comprises microorganisms of the strain BT2013 and optionally a pharmaceutically acceptable excipient, carrier or diluent.

The pharmaceutical composition may be any pharmaceutical composition. In one aspect, the pharmaceutical composition is to be administered orally, enterally or rectally. For example, the composition may be an edible composition. "Edible" means a material that is approved for human or animal consumption.

The pharmaceutical compositions may be for human or animal usage in human and veterinary medicine.

Examples of such suitable excipients for the various different forms of pharmaceutical compositions described herein may be found in the "Handbook of Pharmaceutical Excipients, 2nd Edition, (1994), Edited by A Wade and P J Weller.

Acceptable carriers or diluents for therapeutic use are well known in the pharmaceutical art, and are described, for example, in Remington's Pharmaceutical Sciences, Mack Publishing Co. (A. R. Gennaro edit. 1985).

Examples of suitable carriers include lactose, starch, glucose, methyl cellulose, magnesium stearate, mannitol, sorbitol and the like.

Examples of suitable diluents include one or more of: water, ethanol, glycerol, propylene glycol and glycerin, and combinations thereof.

The choice of pharmaceutical carrier, excipient or diluent can be selected with regard to the intended route of administration and standard pharmaceutical practice. The pharmaceutical compositions may comprise as, or in addition to, the carrier, excipient or diluent any suitable binder(s), lubricant(s), suspending agent(s), coating agent(s), solubilising agent(s).

Examples of suitable binders include starch, gelatin, natural sugars such as glucose, anhydrous lactose, free-flow lactose, beta-lactose, corn sweeteners, natural and synthetic gums, such as acacia, tragacanth or sodium alginate, carboxymethyl cellulose and polyethylene glycol.

Examples of suitable lubricants include sodium oleate, sodium stearate, magnesium stearate, sodium benzoate, sodium acetate, sodium chloride and the like.

Preservatives, stabilizers, dyes and even flavouring agents may be provided in the pharmaceutical composition. Examples of preservatives include sodium benzoate, sorbic acid and esters of p-hydroxybenzoic acid. Antioxidants and suspending agents may be also used.

In one aspect, the microorganisms of strain BT2013 pharmaceutical composition are encapsulated.

The pharmaceutical may be in the form of a solution or as a solid—depending on the use and/or the mode of application and/or the mode of administration.

As used herein, the term "medicament" encompasses medicaments for both human and animal usage in human and veterinary medicine. In addition, the term "medicament" as used herein means any substance, which provides a therapeutic and/or beneficial effect. The term "medicament" as used herein is not necessarily limited to substances, which need Marketing Approval, but may include substances which, can be used in cosmetics, nutraceuticals, food (including feeds and beverages for example), probiotic cultures, nutritional supplements and natural remedies. In addition, the term "medicament" as used herein encompasses a product designed for incorporation in animal feed, for example livestock feed and/or pet food.

Nutritional Supplements

Nutritionally acceptable carriers, diluents and excipients include those suitable for human or animal consumption and that are used as standard in the food industry. Typical nutritionally acceptable carriers, diluents and excipients will be familiar to the skilled person in the art.

In one embodiment, a nutritional supplement comprises microorganisms of strain BT2013 or a host cell comprising an expression vector comprising said polynucleotide sequence, and a nutritional acceptable excipient, carrier or diluent.

In one example, the microorganisms of strain BT2013 are encapsulated.

Feedstuff/Products

A further aspect of the invention relates to feedstuffs, food products, dietary supplements and food additives comprising microorganisms of strain BT2013.

The terms "feedstuff", "food product" "food additive" and "dietary supplement" as used herein are intended to cover all consumable products that can be solid, jellied or liquid.

The term "food product" is used in a broad sense—and covers food for humans as well as food for animals (i.e. a feed). In one aspect, the food product is for human consumption. Examples of food products include diary products (such as milk, cheese, beverages comprising whey protein, milk drinks, lactic acid bacteria drinks, yoghurt, drinking yoghurt), bakery products, beverages and beverage powders.

The "feedstuff", "food product" "food additive" and "dietary supplement" may be in the form of a solution or as a solid—depending on the use and/or the mode of application and/or the mode of administration.

As used herein the term "dietary supplement" includes a formulation which is or can be added to a food product or feedstuff as a nutritional supplement. The term "dietary supplement" as used here also refers to formulations which can be used at low levels in a wide variety of products that require gelling, texturising, stabilising, suspending, film-forming and structuring, retention of juiciness and improved mouthfeel, without adding viscosity.

Suitable food products may include, for example, functional food products, food compositions, pet food, livestock feed, health foods, feedstuffs and the like. In one aspect, the food product is a health food.

As used herein, the term "functional food product" means food that is capable of providing not only a nutritional effect, but is also capable of delivering a further beneficial effect to the consumer. Accordingly, functional foods are ordinary foods that have components or ingredients (such as those described herein) incorporated into them that impart to the food a specific functional—e.g. medical or physiological benefit—other than a purely nutritional effect.

Examples of specific food products that are applicable to the present invention include milk-based products, ready to eat desserts, powders for re-constitution with, e.g., milk or water, chocolate milk drinks, malt drinks, ready-to-eat dishes, instant dishes or drinks for humans or food compositions representing a complete or a partial diet intended for pets or livestock.

In one aspect, the feedstuff, food product, dietary supplement or food additive according to the present invention are intended for humans, pets or livestock such as monogastric animals. The feedstuff, food product, dietary supplement or food additive may be intended for animals selected from the group consisting of dogs, cats, pigs, horses, or poultry. In a further embodiment, the food product, dietary supplement or food additive is intended for adult species, in particular human adults.

The term "milk-based product" as used herein means any liquid or semi-solid milk or whey based product having a varying fat content. The milk-based product can be, e.g., cow's milk, goat's milk, sheep's milk, skimmed milk, whole milk, milk recombined from powdered milk and whey without any processing, or a processed product, such as yoghurt, curdled milk, curd, sour milk, sour whole milk, butter milk and other sour milk products. Another important group includes milk beverages, such as whey beverages, fermented milks, condensed milks, infant or baby milks; flavoured milks, ice cream; milk-containing food such as sweets.

The feedstuffs, food products, dietary supplements or food additives of the present invention may be—or may be added to—food supplements, also referred to herein as dietary or nutritional supplements or food additives.

The feedstuffs, food products, dietary supplements or food additives according to the invention may also be used in animal nutrition (e.g. in pig nutrition), particularly in the early-weaned period and growing fattening period. The feedstuffs, food products, dietary supplements or food additives are expected to enhance immune function reduce and prevent infectious diseases, beneficially alter the microbiota composition, and improve growth and performance of animals, for example, through increased feed conversion efficiency.

In one embodiment the feedstuff, food product, dietary supplement, or food additive is encapsulated.

Live Biotherapeutic Product

The microorganisms of strain BT2013 may be used in or as a live biotherapeutic product (LBP).

In one aspect, the LBP is an orally administrable composition of metabolically active, i.e., live and/or lyophilized, or non-viable heat-killed, irradiated or lysed bacteria. The LBP may contain other ingredients. The LBP can be administered orally, i.e., in the form of a tablet, capsule or powder. The LBP may additionally comprise other bacterial species, for example, the bacterial species $R.$ $hominis$. Encapsulated products are favoured for $R.$ $hominis$ as it is an anaerobe. Other ingredients (such as vitamin C, for example), may be included as oxygen scavengers and substrates (such as these improve the colonisation and survival in vivo). Alternatively, the LBP of the invention may be administered orally as a food or nutritional product, such as milk or whey based fermented dairy product, or as a pharmaceutical product.

A suitable daily dose of the bacteria in the LBP is from about $1 \times 10^3$ to about $1 \times 10^{12}$ colony forming units (CFU); for example, from about $1 \times 10^7$ to about $1 \times 10^{10}$ CFU; in another example from about $1 \times 10^6$ to about $1 \times 10^{10}$ CFU.

In one aspect, the LBP contains the bacterial species and/or cellular components thereof, as active ingredients, in an amount of from about $1 \times 10^6$ to about $1 \times 10^{12}$ CFU/g, respect to the weight of the composition; for example, from about $1 \times 10^8$ to about $1 \times 10^{10}$ CFU/g. Typically, a LBP is optionally combined with at least one suitable prebiotic compound. A prebiotic is usually a non-digestible carbohydrate such as an oligo- or polysaccharide, or a sugar alcohol, which is not degraded or absorbed in the upper digestive tract. Known prebiotics include commercial products such as inulin and transgalacto-oligosaccharides.

In one aspect, the LBP of the present description includes a prebiotic in an amount of from about 1 to about 30% by weight, respect to the total weight composition, (e.g. from 5 to 20% by weight). Carbohydrates may be selected from the group consisting of: fructo-oligosaccharides (or FOS), short-chain fructo-oligosaccharides, inulin, isomalt-oligosaccharides, pectins, xylo-oligosaccharides (or XOS), chitosan-oligosaccharides (or COS), beta-glucans, arable gum modified and resistant starches, polydextrose, D-tagatose, acacia fibers, carob, oats, and citrus fibers. In one aspect, the prebiotics are the short-chain fructo-oligosaccharides (for simplicity shown hereinbelow as FOSs-c.c); said FOSs-c.c. are not digestible carbohydrates, generally obtained by the conversion of the beet sugar and including a saccharose molecule to which three glucose molecules are bonded.

Administration

The pharmaceutical compositions, the nutritional supplements, feedstuffs, food products, dietary supplements or food additives of the present invention may be adapted for oral, rectal, vaginal, parenteral, intramuscular, intraperitoneal, intraarterial, intrathecal, intrabronchial, subcutaneous, intradermal, intravenous, nasal, buccal or sublingual routes of administration.

In one aspect, the pharmaceutical compositions, the nutritional supplements, feedstuffs, food products, dietary supplements or food additives of the present invention are adapted for oral, rectal, vaginal, parenteral, nasal, buccal or sublingual routes of administration.

In a further aspect, the pharmaceutical compositions, the nutritional supplements, feedstuffs, food products, dietary supplements or food additives of the present invention are adapted for oral administration.

For oral administration, particular use is made of compressed tablets, pills, tablets, gellules, drops, and capsules.

Other forms of administration comprise solutions or emulsions which may be injected intravenously, intraarterially, intrathecally, subcutaneously, intradermally, intraperitoneally or intramuscularly, and which are prepared from sterile or sterilisable solutions. The pharmaceutical compositions of the present invention may also be in form of suppositories, pessaries and suspensions. Pharmaceutical compositions, the nutritional supplements, feedstuffs, food products, dietary supplements or food additives may be formulated in unit dosage form, i.e., in the form of discrete portions containing a unit dose, or a multiple or sub-unit of a unit dose.

Dosage

A person of ordinary skill in the art can easily determine an appropriate dosage amount of the strain BT2013 to administer to a subject without undue experimentation. Typically, a physician will determine the actual dosage which will be most suitable for an individual patient and it will depend on a variety of factors including the activity of the strain employed, the metabolic stability and length of action of that strain, the age, body weight, general health, sex, diet, mode and time of administration, rate of excretion, drug combination, the severity of the particular condition, and the individual undergoing therapy. The dosages disclosed herein are exemplary of the average case. There can of course be individual instances where higher or lower dosage ranges are merited, and such are within the scope of this invention.

Combinations

In one aspect, microorganisms of strain BT2013 are administered in combination with one or more other active agents. In such cases, the microorganisms of strain BT2013 may be administered consecutively, simultaneously or sequentially with the one or more other active agents.

Functional Assays:

In Vivo Model

C57BL/6 mice (6 weeks old) were used to evaluate the therapeutic effect of *B. thetaiotaomicron* strains E1, E2 and BT2013 during DSS-induced colitis. The mice were colonised with one of the *B. thetaiotaomicron* strains prior to treatment with DSS. The animals were euthanized and intestinal tissue sampling was performed. Small intestine was collected for immunological analysis by flow cytometry and enzymatic activity measurements of the enzyme myeloperoxidase (MPO). Ascending colon were divided into equal parts and transferred to neutral buffered formalin (NBF; Sigma-Aldrich) for histological analysis or RNAlater (Ambion) for molecular analysis.

Figure 2:
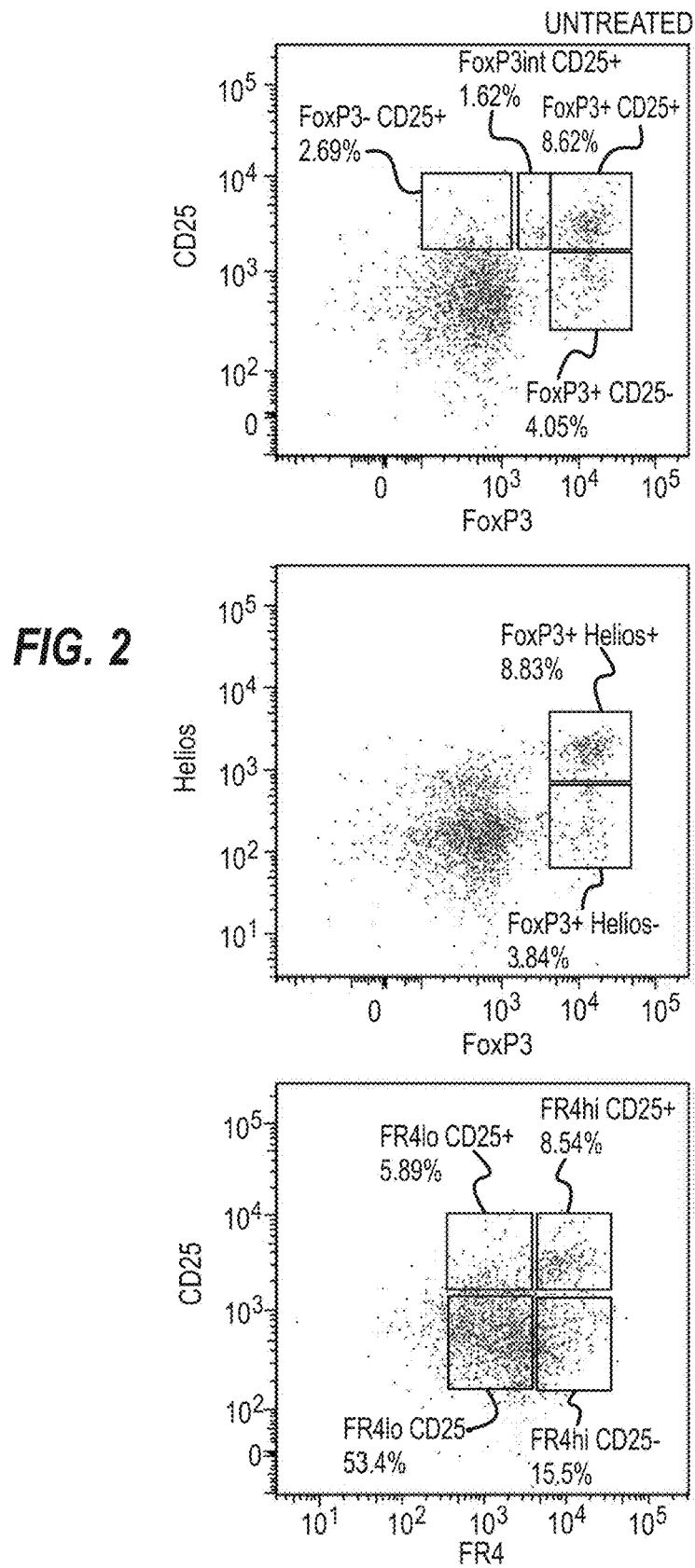
FIG. 2 illustrates that *B. thetaiotaomicron* strain BT2013 does not influence Treg cells, but influences Teff cells, in conventional mice.

Flow cytometry analysis of T cell populations in small intestine lamina propria was carried out (FIG. 1 and FIG. 2). DSS alone and *B. thetaiotaomicron* treatment did not affect the total percentage of the CD3+CD4+CD8-population. The populations influenced by DSS alone and *B. thetaiotaomicron* were the Tregs (CD25+FoxP3+* and FR4$^{hi}$CD25+*) and Teff cells (FR4$^{lo}$ CD25+*) (FIGS. 1 and 2). The percentage of Tregs was increased in mice treated with *B. thetaiotaomicron* strain BT2013 compared to DSS alone. The strain E1W did not appear to have any effect on Tregs. (FIG. 1). The effects of BT2013 in Tregs were only apparent in mice co-treatment with DSS. The strain had no effect on Tregs in untreated mice but did influence the Teff cell population (FIG. 2).

Figure 3A:
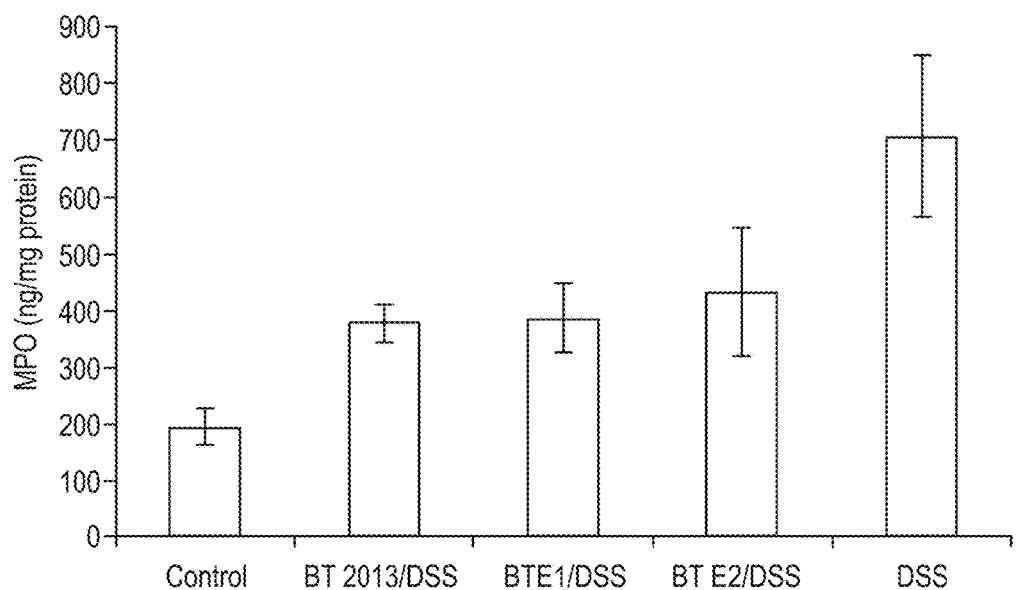
FIGS. 3A and 3B: illustrate the myeloperoxidase (MPO) activity in ileum (FIG. 3A) and caecum (FIG. 3B) of mice dosed with DSS with or without a daily intake of *B. thetaiotaomicron*
Figure 3B:
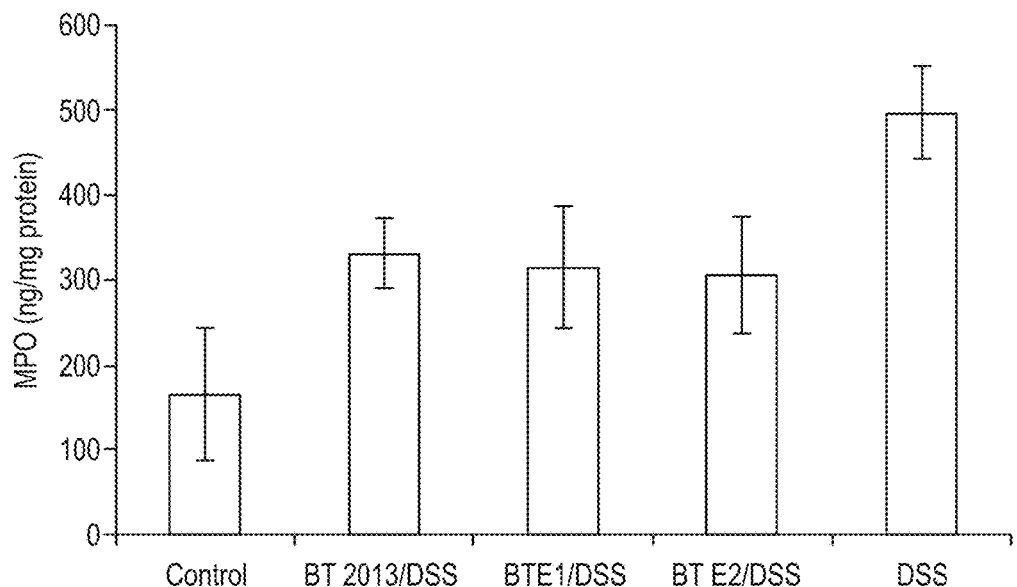

The enzymatic activity of MPO in the ileum and caecum was determined (FIGS. 3a and 3b). MPO is a proinflammatory enzyme stored in the azurophilic granules of neutrophilic granulocytes. MPO is used as an indicator of inflammation, specifically neutrophil recruitment and accumulation. The lower levels of MPO activity detected in ileal or caecal tissue samples from the *B. thetaiotaomicron*/DSS treated mice compared to DSS alone indicates a reduction in neutrophil recruitment and therefore a reduction in inflammation.

Figure 4A:
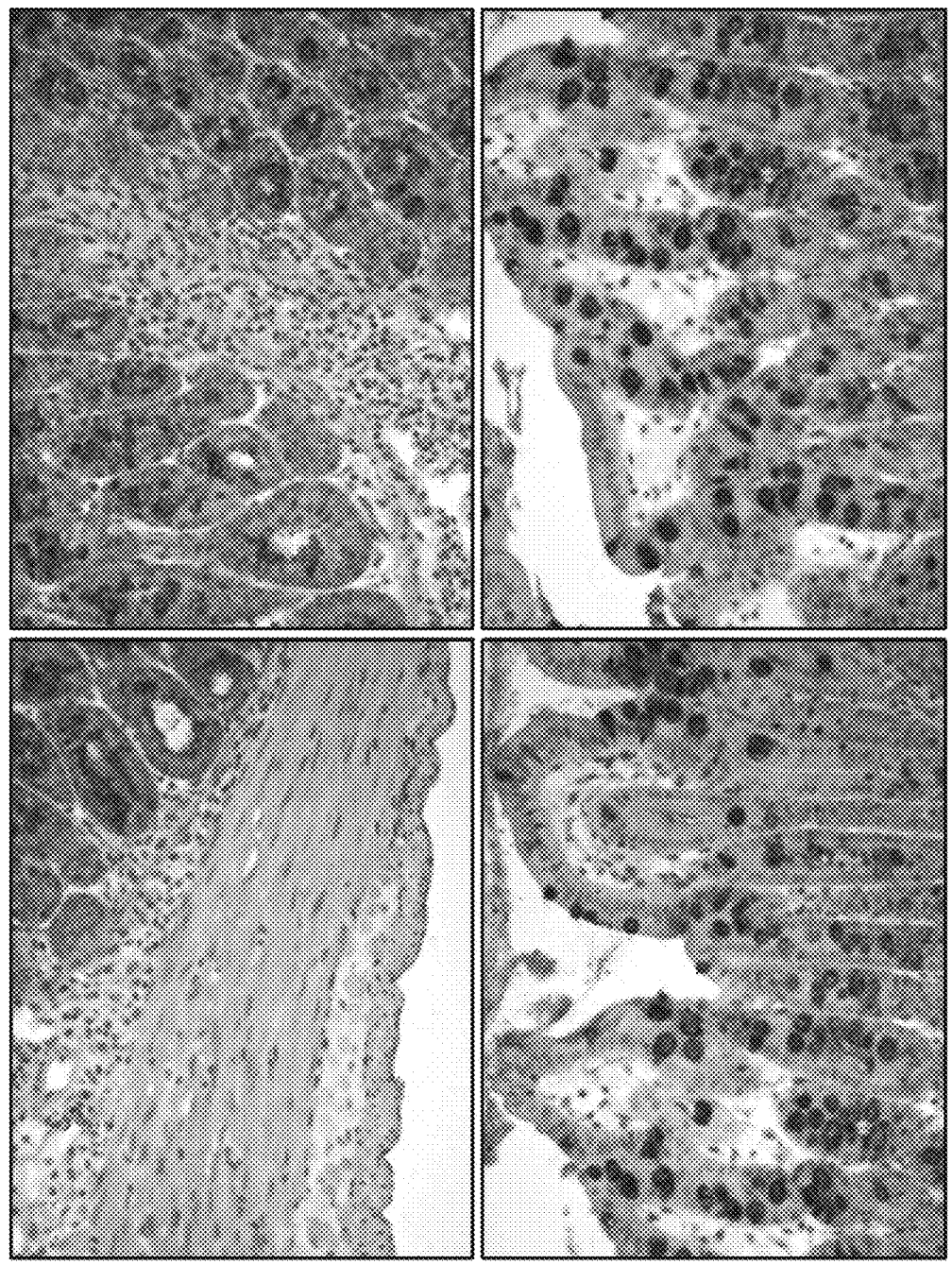
FIGS. 4A and 4B: illustrate histopathology in ascending colon of female C57131/6 mice dosed with DSS (FIG. 4A) or DSS and *B. thetaiotaomicron* (FIG. 4B)
Figure 4B:
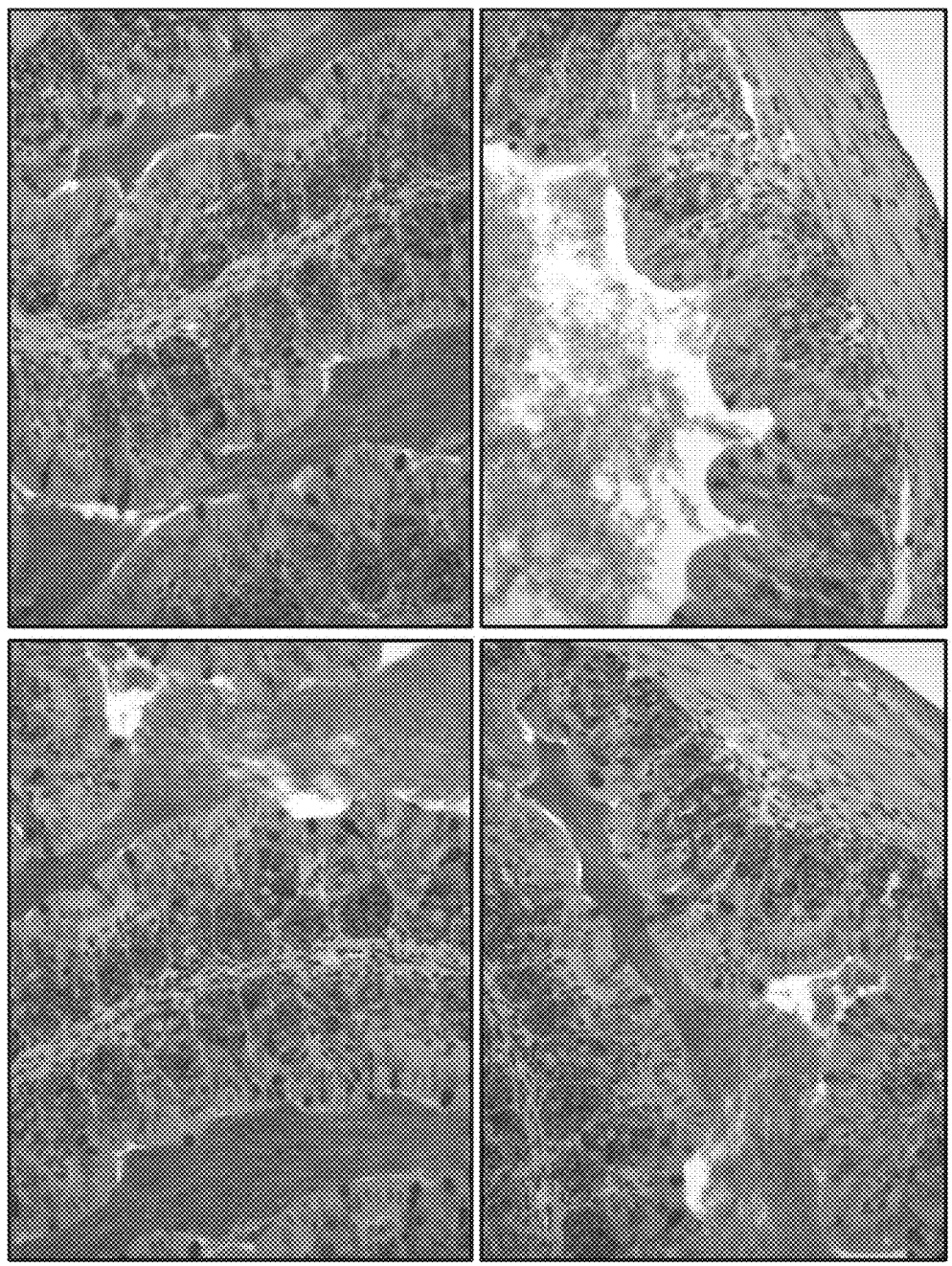
Figure 5:
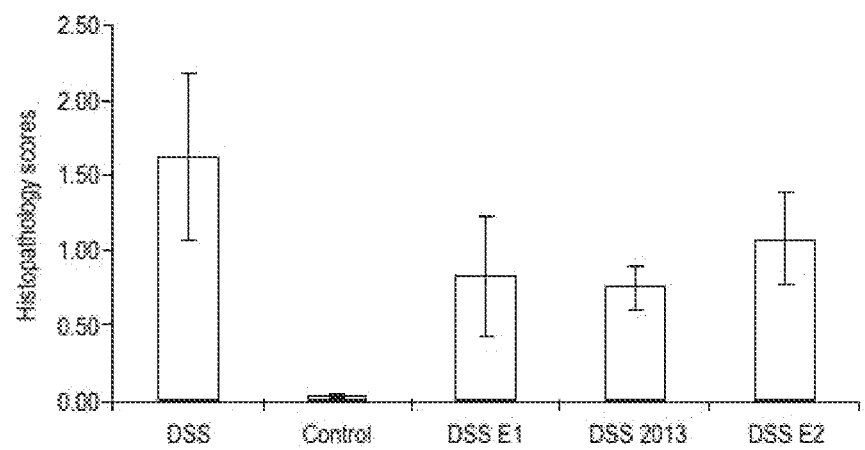
FIG. 5: illustrates the mean histopathological tissue scores for the ascending colon from mice colonised with *B. thetaiotaomicron* strains E1 and BT2013 during DSS-induced colitis.

Histological analysis of ascending colon was carried out (FIGS. 4A, 4B, and 5 and Table 1). The histopathology grading scheme was based on the criteria of Berg et al 1996, as summarised:

0=Shallow crypts, no or few infiltrating inflammatory cells, intact epithelium, goblet cells appear full of mucin. ie no pathology 1=Crypts may exhibit slight epithelial cell hyperplasia, some diffuse infiltrating inflammatory cells may be seen between crypts, luminal epithelium appears intact, goblet cells may appear slightly depleted of mucin.

2=Crypts appear deeper with distinct evidence of epithelial hyperplasia, depletion of mucin from goblet cells, infiltrating inflammatory cells evident and may be multifocal in nature, though the infiltrates are not seen in the submucosa.

3=Lesions involved a larger area of the mucosa and/or were more frequent than that seen in grade 2. The lesions did not involve the submucosa.

The luminal epithelial cells exhibited small erosions. The lesions are not transmural.

4=Crypt epithelium appears eroded. Abscesses may be present.

Luminal epithelial cells appear irregular, sometimes with complete loss.

Transmural infiltrate is observed—this was often associated with complete loss of epithelial cells into the lumen.

Figure 6:
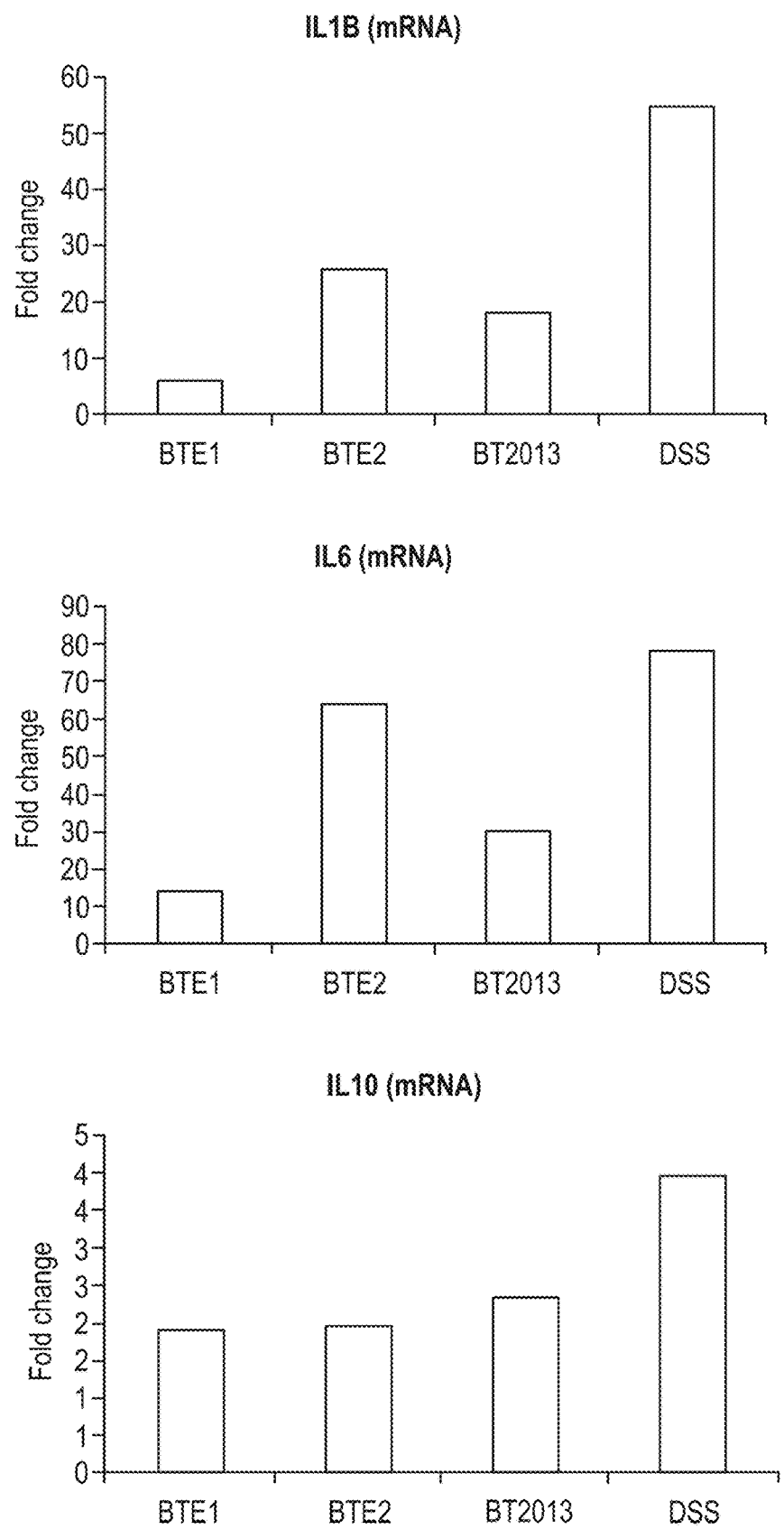
FIG. 6: illustrates the expression of proinflammatory genes (IL-1β and IL-6) and anti-inflammatory gene (IL-10) in the ascending colon of mice treated with *B. thetaiotaomicron* strains E1, E2 and BT2013.

The disruption to the colon as a result of DSS induced colitis was significantly reduced by treatment of mice with *B. thetaiotaomicron* strains E1, E2 and BT2013. The expression of inflammation-associated genes in the ascending colon was reduced in mice colonised with *B. thetaiotaomicron* compared to mice treated with DSS alone. The strains E1 and BT2013 greatly reduced IL1B and IL6 inflammatory gene expression compared to strain E2. (FIG. 6)

TABLE 1

| TTEST | CONTROL | BT E1 | BT 2013 | BT E2 |
|---|---|---|---|---|
| DSS | 0.000 | 0.032 | 0.041 | 0.089 |

In Vitro Model

Figure 7:
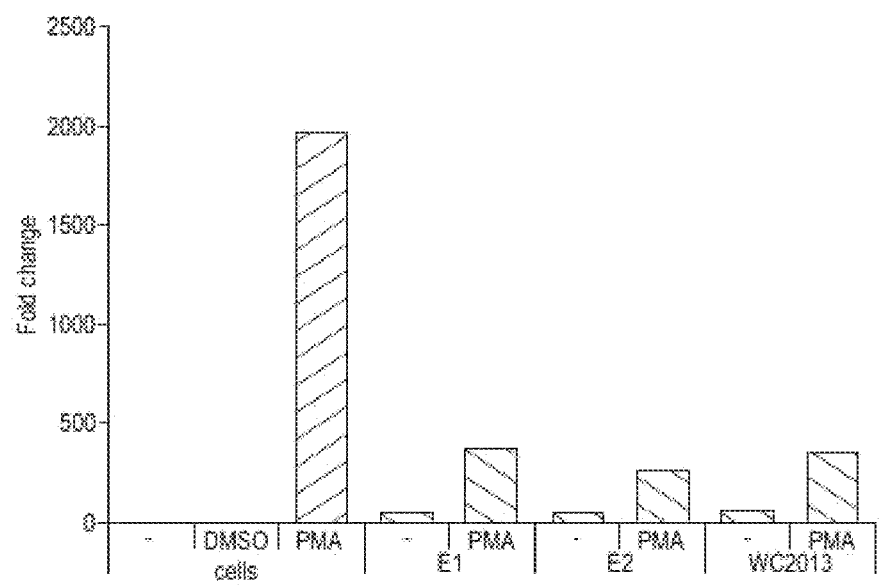
FIG. 7: illustrates the expression of IL-8 in Caco-2 cells incubated with PMA and medium or bacterial cells E1, E2 and BT2013.

The expression of the inflammatory gene interleukin-8 induced in intestinal epithelial cells after PMA exposure was modulated in the presence of *B. thetaiotaomicron* strains E1, E2 and BT2013 (FIG. 7).

Sequencing of Strain BT2013 Genome

A DNA sample from strain BT2013 was subjected to sequencing on MiSeq (v2 nano 2×250 bp) using a Nextera XT library for fast fragmentation and tagging with sequencing adaptors, to give a total of 4605120 reads (1115615927 bases).

The data analysis is summarised below:
a. Mapping to reference sequence (NC_004663 and NC_004703) using bowtie2 (2.2.2)
b. SNV and small InDel calling using VarScan (2.3.7) and SNVer (0.5.3) performing a consensus call to avoid false positives
c. Annotation of variations using reference gff
d. Large InDel calling using pindel (0.2.5a3)
e. De-novo assembly of unmapped reads using SOAPdenovo (2.04)
f. Blast of assembled contigs against NCBI nt database
g. Subsampling of all reads of the sample to 50%
h. De-novo assembly on the subsampled reads using SOAPdenovo (2.04)

The sequences were mapped to the reference sequence (NC_004663 and NC_004703) using bowtie2 (2.2.2). Nucleotide variations and small insertions and/or deletions were identified using VarScan (2.3.7) and SNVer (0.5.3) to avoid false positives during sequencing and variations were annotated using a reference sequence. Large insertions and deletions were identified using pindel (0.2.5a3). Unmapped reads were assembled de novo using SOAPdenovo (2.04). The sequencing fragments were reassembled into contigs which were blasted against the NCBI nucleotide database. All the reads of the sample were subsampled to 50% and were then assembled de novo using SOAPdenovo (2.04) to provide a concatenated version of the de novo sequence assembly of BT2013.

Sequences SEQ ID NO:1 (concatenated version of the de novo sequence assembly of BT2013)—see electronic sequence listing.

SEQUENCE LISTING (2 sequences)

SEQ ID NO: 1 - DNA, 6574984 bp, Bacteroides thetaiotaomicron (residues 1-1,643,746 of 6,574,984)
  modified_base (3086269)..(3087366): a, c, t, g, unknown or other
  modified_base (3089801)..(3090739): a, c, t, g, unknown or other
  modified_base (3091393)..(3092429): a, c, t, g, unknown or other
  modified_base (3106348)..(3107421): a, c, t, g, unknown or other
  modified_base (3107552)..(3107552): a, c, t, g, unknown or other
  modified_base (3113768)..(3114749): a, c, t, g, unknown or other
  modified_base (3115110)..(3116153): a, c, t, g, unknown or other
  modified_base (3117671)..(3118702): a, c, t, g, unknown or other
  modified_base (3118837)..(3119841): a, c, t, g, unknown or other
  modified_base (3120490)..(3121433): a, c, t, g, unknown or other
  modified_base (3121700)..(3122759): a, c, t, g, unknown or other
  modified_base (3124187)..(3125199): a, c, t, g, unknown or other
  modified_base (3125625)..(3126715): a, c, t, g, unknown or other
  modified_base (3126925)..(3127959): a, c, t, g, unknown or other
  modified_base (3130399)..(3131477): a, c, t, g, unknown or other
  modified_base (3131746)..(3132762): a, c, t, g, unknown or other
  modified_base (3132924)..(3133929): a, c, t, g, unknown or other
  modified_base (3134295)..(3135398): a, c, t, g, unknown or other
  modified_base (3136185)..(3137244): a, c, t, g, unknown or other
  modified_base (3137388)..(3138353): a, c, t, g, unknown or other
  modified_base (3139288)..(3139288): a, c, t, g, unknown or other
  modified_base (3164719)..(3165785): a, c, t, g, unknown or other
  modified_base (3165929)..(3167041): a, c, t, g, unknown or other
  modified_base (3178834)..(3178834): a, c, t, g, unknown or other
  modified_base (3178981)..(3180054): a, c, t, g, unknown or other
  modified_base (3213054)..(3214095): a, c, t, g, unknown or other
  modified_base (3266722)..(3267701): a, c, t, g, unknown or other
  modified_base (3268983)..(3270063): a, c, t, g, unknown or other
  modified_base (3270469)..(3271515): a, c, t, g, unknown or other
  modified_base (3271706)..(3272840): a, c, t, g, unknown or other
  modified_base (3272988)..(3274104): a, c, t, g, unknown or other
  modified_base (3274257)..(3275337): a, c, t, g, unknown or other
  modified_base (3275556)..(3276608): a, c, t, g, unknown or other
  modified_base (3282524)..(3283610): a, c, t, g, unknown or other
  modified_base (3309481)..(3310560): a, c, t, g, unknown or other
  modified_base (3310731)..(3311764): a, c, t, g, unknown or other
  modified_base (3312164)..(3313150): a, c, t, g, unknown or other
  modified_base (3322229)..(3323308): a, c, t, g, unknown or other
  modified_base (3323479)..(3324477): a, c, t, g, unknown or other
  modified_base (3324954)..(3325979): a, c, t, g, unknown or other
  modified_base (3331465)..(3332451): a, c, t, g, unknown or other
  modified_base (3372880)..(3373968): a, c, t, g, unknown or other
  modified_base (3374982)..(3376085): a, c, t, g, unknown or other
  modified_base (3376261)..(3377274): a, c, t, g, unknown or other
  modified_base (3377709)..(3378867): a, c, t, g, unknown or other
  modified_base (3380356)..(3381433): a, c, t, g, unknown or other
  modified_base (3382279)..(3383294): a, c, t, g, unknown or other
  modified_base (3388698)..(3389726): a, c, t, g, unknown or other
  modified_base (3390087)..(3391062): a, c, t, g, unknown or other
  modified_base (3392624)..(3393662): a, c, t, g, unknown or other
  modified_base (3394313)..(3395258): a, c, t, g, unknown or other
  modified_base (3395495)..(3396471): a, c, t, g, unknown or other
  modified_base (3432253)..(3433234): a, c, t, g, unknown or other
  modified_base (3433484)..(3434578): a, c, t, g, unknown or other
  modified_base (3446168)..(3447101): a, c, t, g, unknown or other
  modified_base (3448344)..(3449342): a, c, t, g, unknown or other
  modified_base (3449662)..(3450667): a, c, t, g, unknown or other
  modified_base (3450944)..(3451993): a, c, t, g, unknown or other
  modified_base (3452251)..(3453250): a, c, t, g, unknown or other
  modified_base (3478003)..(3478957): a, c, t, g, unknown or other
  modified_base (3479220)..(3480217): a, c, t, g, unknown or other
  modified_base (3494115)..(3495115): a, c, t, g, unknown or other
  modified_base (3506325)..(3506504): a, c, t, g, unknown or other
  modified_base (3513395)..(3514419): a, c, t, g, unknown or other
  modified_base (3517779)..(3518778): a, c, t, g, unknown or other
  modified_base (3519082)..(3520021): a, c, t, g, unknown or other
  modified_base (3562326)..(3563267): a, c, t, g, unknown or other
  modified_base (3597338)..(3598433): a, c, t, g, unknown or other
  modified_base (3598774)..(3599803): a, c, t, g, unknown or other
  modified_base (3629452)..(3630436): a, c, t, g, unknown or other
  modified_base (3635887)..(3636772): a, c, t, g, unknown or other
  modified_base (3637126)..(3637126): a, c, t, g, unknown or other
  modified_base (3637480)..(3638348): a, c, t, g, unknown or other
  modified_base (3639828)..(3640883): a, c, t, g, unknown or other
  modified_base (3648231)..(3649236): a, c, t, g, unknown or other
  modified_base (3651864)..(3652922): a, c, t, g, unknown or other
  modified_base (3657906)..(3658902): a, c, t, g, unknown or other
  modified_base (3659285)..(3660310): a, c, t, g, unknown or other
  modified_base (3678408)..(3679474): a, c, t, g, unknown or other
  modified_base (3749882)..(3750948): a, c, t, g, unknown or other
  modified_base (3753169)..(3754209): a, c, t, g, unknown or other
  modified_base (3782813)..(3783835): a, c, t, g, unknown or other
  modified_base (3784945)..(3785978): a, c, t, g, unknown or other
  modified_base (3790071)..(3791160): a, c, t, g, unknown or other
  modified_base (3800843)..(3801756): a, c, t, g, unknown or other
  modified_base (3802212)..(3803250): a, c, t, g, unknown or other
  modified_base (3811732)..(3812710): a, c, t, g, unknown or other
  modified_base (3847664)..(3848698): a, c, t, g, unknown or other
  modified_base (3854789)..(3855853): a, c, t, g, unknown or other
  modified_base (3858039)..(3859049): a, c, t, g, unknown or other
  modified_base (3860560)..(3861590): a, c, t, g, unknown or other
  modified_base (3870133)..(3871139): a, c, t, g, unknown or other
  modified_base (3879481)..(3880446): a, c, t, g, unknown or other
  modified_base (3901161)..(3902080): a, c, t, g, unknown or other
  modified_base (3907873)..(3908882): a, c, t, g, unknown or other
  modified_base (3918385)..(3919305): a, c, t, g, unknown or other
  modified_base (3935681)..(3936577): a, c, t, g, unknown or other
  modified_base (3969457)..(3970358): a, c, t, g, unknown or other
  modified_base (3972432)..(3973409): a, c, t, g, unknown or other
  modified_base (3975855)..(3976838): a, c, t, g, unknown or other
  modified_base (3984840)..(3985859): a, c, t, g, unknown or other
  modified_base (4058825)..(4059845): a, c, t, g, unknown or other
  modified_base (4060683)..(4061676): a, c, t, g, unknown or other
  modified_base (4065213)..(4066324): a, c, t, g, unknown or other
  modified_base (4073969)..(4075026): a, c, t, g, unknown or other
  modified_base (4103704)..(4104683): a, c, t, g, unknown or other
  modified_base (4120806)..(4121757): a, c, t, g, unknown or other
  modified_base (4140620)..(4141640): a, c, t, g, unknown or other
  modified_base (4143858)..(4144882): a, c, t, g, unknown or other
  modified_base (4150214)..(4151156): a, c, t, g, unknown or other
  modified_base (4152422)..(4153371): a, c, t, g, unknown or other
  modified_base (4187698)..(4188792): a, c, t, g, unknown or other
  modified_base (4192160)..(4193162): a, c, t, g, unknown or other
  modified_base (4194106)..(4195084): a, c, t, g, unknown or other
  modified_base (4204103)..(4205139): a, c, t, g, unknown or other
  modified_base (4214844)..(4215852): a, c, t, g, unknown or other
  modified_base (4252311)..(4253359): a, c, t, g, unknown or other
  modified_base (4291725)..(4292634): a, c, t, g, unknown or other
  modified_base (4305214)..(4306258): a, c, t, g, unknown or other
  modified_base (4311637)..(4311637): a, c, t, g, unknown or other
  modified_base (4312717)..(4313689): a, c, t, g, unknown or other
  modified_base (4318946)..(4319934): a, c, t, g, unknown or other
  modified_base (4322538)..(4323489): a, c, t, g, unknown or other
  modified_base (4329249)..(4330245): a, c, t, g, unknown or other
  modified_base (4335669)..(4336641): a, c, t, g, unknown or other
  modified_base (4343793)..(4344804): a, c, t, g, unknown or other
  modified_base (4345961)..(4346979): a, c, t, g, unknown or other
  modified_base (4355771)..(4356779): a, c, t, g, unknown or other
  modified_base (4364383)..(4365185): a, c, t, g, unknown or other
  modified_base (4396745)..(4397759): a, c, t, g, unknown or other
  modified_base (4401693)..(4402682): a, c, t, g, unknown or other
  modified_base (4415944)..(4416954): a, c, t, g, unknown or other
  modified_base (4425464)..(4426331): a, c, t, g, unknown or other
  modified_base (4435980)..(4436973): a, c, t, g, unknown or other
  modified_base (4438376)..(4439324): a, c, t, g, unknown or other
  modified_base (4467801)..(4468810): a, c, t, g, unknown or other
  modified_base (4470241)..(4471231): a, c, t, g, unknown or other
  modified_base (4514442)..(4515481): a, c, t, g, unknown or other
  modified_base (4564053)..(4564974): a, c, t, g, unknown or other
  modified_base (4566413)..(4567393): a, c, t, g, unknown or other
  modified_base (4569436)..(4570455): a, c, t, g, unknown or other
  modified_base (4595936)..(4596934): a, c, t, g, unknown or other
  modified_base (4598411)..(4599397): a, c, t, g, unknown or other
  modified_base (4603665)..(4604635): a, c, t, g, unknown or other
  modified_base (4606928)..(4607950): a, c, t, g, unknown or other
  modified_base (4619209)..(4620169): a, c, t, g, unknown or other
  modified_base (4621701)..(4622691): a, c, t, g, unknown or other
  modified_base (4633050)..(4633968): a, c, t, g, unknown or other
  modified_base (4635610)..(4636591): a, c, t, g, unknown or other
  modified_base (4646982)..(4648013): a, c, t, g, unknown or other
  modified_base (4664923)..(4665916): a, c, t, g, unknown or other
  modified_base (4667654)..(4668638): a, c, t, g, unknown or other
  modified_base (4677603)..(4678498): a, c, t, g, unknown or other
  modified_base (4693843)..(4694867): a, c, t, g, unknown or other
  modified_base (4698812)..(4699799): a, c, t, g, unknown or other
  modified_base (4702275)..(4703181): a, c, t, g, unknown or other
  modified_base (4712950)..(4713869): a, c, t, g, unknown or other
  modified_base (4727043)..(4728060): a, c, t, g, unknown or other
  modified_base (4751977)..(4752968): a, c, t, g, unknown or other
  modified_base (4758397)..(4759468): a, c, t, g, unknown or other
  modified_base (4810049)..(4811037): a, c, t, g, unknown or other
  modified_base (4813593)..(4814549): a, c, t, g, unknown or other
  modified_base (4826770)..(4827751): a, c, t, g, unknown or other
  modified_base (4852232)..(4853201): a, c, t, g, unknown or other
  modified_base (4857234)..(4858276): a, c, t, g, unknown or other
  modified_base (4899764)..(4900709): a, c, t, g, unknown or other
  modified_base (4915361)..(4916403): a, c, t, g, unknown or other
  modified_base (4923123)..(4924049): a, c, t, g, unknown or other
  modified_base (4981980)..(4982982): a, c, t, g, unknown or other
  modified_base (5006768)..(5007803): a, c, t, g, unknown or other
  modified_base (5015415)..(5016420): a, c, t, g, unknown or other
  modified_base (5037740)..(5038750): a, c, t, g, unknown or other
  modified_base (5055551)..(5056521): a, c, t, g, unknown or other
  modified_base (5073303)..(5074261): a, c, t, g, unknown or other
  modified_base (5087695)..(5088664): a, c, t, g, unknown or other
  modified_base (5098455)..(5099391): a, c, t, g, unknown or other
  modified_base (5142917)..(5143940): a, c, t, g, unknown or other
  modified_base (5154721)..(5155583): a, c, t, g, unknown or other
  modified_base (5169050)..(5170065): a, c, t, g, unknown or other
  modified_base (5178737)..(5179784): a, c, t, g, unknown or other
  modified_base (5200315)..(5201257): a, c, t, g, unknown or other
  modified_base (5267717)..(5268744): a, c, t, g, unknown or other
  modified_base (5274027)..(5275119): a, c, t, g, unknown or other
  modified_base (5291752)..(5292787): a, c, t, g, unknown or other
  modified_base (5304891)..(5305929): a, c, t, g, unknown or other
  modified_base (5348717)..(5349736): a, c, t, g, unknown or other
  modified_base (5388072)..(5389057): a, c, t, g, unknown or other
  modified_base (5414978)..(5415906): a, c, t, g, unknown or other
  modified_base (5446593)..(5447513): a, c, t, g, unknown or other
  modified_base (5453569)..(5454590): a, c, t, g, unknown or other
  modified_base (5469051)..(5470113): a, c, t, g, unknown or other
  modified_base (5493387)..(5494410): a, c, t, g, unknown or other
  modified_base (5531709)..(5532692): a, c, t, g, unknown or other
  modified_base (5552166)..(5553215): a, c, t, g, unknown or other
  modified_base (5568780)..(5569796): a, c, t, g, unknown or other
  modified_base (5602139)..(5603097): a, c, t, g, unknown or other
  modified_base (5628415)..(5629399): a, c, t, g, unknown or other
  modified_base (5646327)..(5647377): a, c, t, g, unknown or other
  modified_base (5701273)..(5702304): a, c, t, g, unknown or other
  modified_base (5719941)..(5721004): a, c, t, g, unknown or other
  modified_base (5746425)..(5747350): a, c, t, g, unknown or other
  modified_base (5769057)..(5770088): a, c, t, g, unknown or other
  modified_base (5780223)..(5781300): a, c, t, g, unknown or other
  modified_base (5812156)..(5813205): a, c, t, g, unknown or other
  modified_base (5851790)..(5852836): a, c, t, g, unknown or other
  modified_base (5869385)..(5870362): a, c, t, g, unknown or other
  modified_base (5891220)..(5892227): a, c, t, g, unknown or other
  modified_base (5916216)..(5917236): a, c, t, g, unknown or other
  modified_base (5928575)..(5929592): a, c, t, g, unknown or other
  modified_base (5950724)..(5951610): a, c, t, g, unknown or other
  modified_base (5974185)..(5975118): a, c, t, g, unknown or other
  modified_base (6007564)..(6008522): a, c, t, g, unknown or other
  modified_base (6039584)..(6040583): a, c, t, g, unknown or other
  modified_base (6072330)..(6073260): a, c, t, g, unknown or other
  modified_base (6164462)..(6165495): a, c, t, g, unknown or other
  modified_base (6179215)..(6180279): a, c, t, g, unknown or other
  modified_base (6211862)..(6212870): a, c, t, g, unknown or other
  modified_base (6250362)..(6251324): a, c, t, g, unknown or other
  modified_base (6292263)..(6293251): a, c, t, g, unknown or other
  modified_base (6347156)..(6348125): a, c, t, g, unknown or other
  modified_base (6401673)..(6402745): a, c, t, g, unknown or other
  modified_base (6468949)..(6469921): a, c, t, g, unknown or other
  modified_base (6537627)..(6538765): a, c, t, g, unknown or other
aaaaaaaaagggtccaatttgatttattttggtcccggtgtgcataatcttcctaatgatactctatttgtcccctcaggaactactgtttatatcgatgggggagctcgtgtttatggcaatatattaaaataagtaaaccggaggcaggaataataaataataaagtaaacagctgccagggttagtaatatttctagtcaacacatagcagctattagagataaacaagtcaaccattattagggaagtacatacatatgccatcggattaatctgatgcaaagctacaaattcaagtccgttcgctcggaaaatcgctgtaactaactaaatttcaaatatttcaaagaactcttttagattttaatgggacagcaatgaaccaacaaaagacaactaacataggaataagaataacaaaagtaaacctatttagatattaaagtatattgagtaaactaattcagttataacaaacgaagttgtcaactaaaaccagtacacatcataccaacaaaagacaactaacataggaataagaataacaaaagtaaacctatttagatattaaagtatattgagtaaactaattcagttataacaaacgaagttgtcaactaaaaccagtacacatcagattattaaagaatttcggttatcgatggggatgcgttccattaggcagttggtgaggtaacggctcaccaaaccttcgatggataggggttctgagaggaaggtcccccacattggaactgagacacgatggagtgcatacaagagccagtccattccaggatatattacctttaagaatggactggatagattttatacacagtttgaactgtatgagttaatcagctaagacttgtgtataaagggtagcttccagagagttgcagtctgattcagcctatagtcatttaagactagtgtcaaagttagttcactgcaactctacttttcaaatatacacttatattttgttgtgatatttaatactgcaaatgtaaatgtgaggaggggatcttgtttaacgaacggctgtatcaaacaccgattcgaaaggacgtttgggacgcagataagaaacgcattccggcacgtaacatgattatcgtcgcatcgacgggtgggggaaagtcgcaacggaacccagtacgaaagaaaccagcaggaagaacccaagcacaacggaacccagtacgaaagaaaccagcaggaagaacccaagcacaacggaacccagtacgaaagaaaccagcaggaagaacctgataagactcatctgagagacctctttgataaaactaaatttcaaaatgacaaagaacgattcggaccaaatgggccaagtttatttaatttttaattcgtcccaattttaatgggacactaatgactgtagtgtactgaataagttgacacttcaaaaatcgaaaataaagatgaaatattcgaaaaagaagtacaactattacagtgatgatgaacgaatgtcttatattcgtgagtatttatcaagtcccgcgaccctcaaaagagggcttcgatattgtcattggcaatccaccgtacggagcgaaatacgacaaccaaacaaagaggtattataagaatacctatgtgacggcaaatagcatccgaggattacagaacgcgtcctcgcaatctctcagtagaggtcaatggagatatttttcacaatcttcatctttttgcgaatccgattgataaatttcgtccttccgataaagaaatccaaagggctctcaagaaaaaaaaatctgtagtgtactgaataagttgacacttcaaaaatcgaaaataaagatgaaatattcgaaaaagaagtacaactattacagtgatgatgaacgaatgtcttatattcgtgagtatttatcaagtcccttaaagtatgaacgcttacaagaattgtctgcttacggtgacagatttgttttcataaaagacagtattgctaaaaaggaaattgttgagtctattttcactaactaccatcctcaggtagtcgtgaatgcccgtgagcgattcgccactacgcagttgagataacgctttgtcacgcatctgctgatactcttcactgtttctatccataatacaaagataattgtttggggacagagttcagattacgccctcctgtcgctgcggaacgtagagtaattgatccccatgcagagcgacgaatgcagatccgaaagaaacaggtagtccggattcaggttgttttcccggccgatgatcgagcctataaagatattataaagcaacggggaattacagaaccgttactacccaagacgttaccaaagcgggtagtgataaatttggtatggccttttacttttccctcacggatagcacatcccagactctgtacatagatttcggccaatcacacacacacacacacacacacacacacacgagtgtgtgtagaaacctatatttaagacttttcaaggtaattctcctttcttttttatcgtgttccgttcttttcgtttccgctcaagagacacgggaagccaagagcaaaattcttgaccttgccatacatggtaagctagtaccacaagatcccaatgaagagccagcaattaagctgttgaagcgtataaatcccgacttcacaccttgtgataacgggcattaagtgtcttaccctggatttggttgactactataagtatcaactaaaatgaataaaagatgaaaaagagtgacatgacctttagtccttatcagcttgaacttcttggcgatttctatcgttcgaatttccgggacttgataaatactcacgaatataagacattcgttcatcatcactgtaatagttgtacttctttttcgaatatttcatctttattttcgatttttgaagtgtcaacttattcagtacactacaaagtttttggttagttgctctttctggggtagcagatattttatagtaagttatatgcaaaaaaaacagaaaaaagttggaaatattgattttttttataaacacacacacacacacacacacacacacacaactctcgttgggaccctttatcccgaagttacagggtcaatttgcctagttccttaaccgtgaatcactcaagcgccttagtatattcaacccgactacgtgtgtccgtttgcggtacgggtaccttaaagactgatgtgtactggttttagttgacaacttcgtttgttataactgaattagtttactcaatatactttaatatctaaataggtttacttttgttattcttattcctatgttagttgtcttttgttggccgttttcgtcagcctcactgatactcggagcaatcaacgttttcaatccactccttttacaatactgaagcaggcggtcttcctcttcacgggtattctcgtaacgggcaaacaggatgccgccgatacatgacttttgacacatttacatttgcagtattaaatatcacaacaaaatataagtgtatatttgaaaagtagagttgcagtgaactaactttgacactagtcttaaatgactataggctgaatcagactgcaatgctgcacaactatcgtaacaatccctgtgtagtgatgtggagtatcggtaatgaagtccccacgcaatgcagccctgtaggatataaagtagccaagttcctgcaagatatctgccaccgtgaagaccctccctacccgccccgttacctgcggcatggaccaagtgacttgtgttctagccaacggatttgctgccatgatcgatatccccggtctgaactaccgcgccaatcgctatcaggaggcatatgacaaacttccccggatctgcgtgccacggatattccggataatggaaactgcactctccaccgattccagaaactcggccagcctgtcccggtctgccttcgccagtttctcgctatacgccaacgggttggcctggtacgcttttgacacatttacatttgcagtattaaatatcacaacaaaatataagtgtatatttgaaaagtagagttgcagtgaactaactttgacactagtcttaaatgactataggctgaatcagactgcaactctcgctcagtgaaattgtagtatcggtgaagatgccgattacccgcgatgggacgaaaagaccccgtgaacctttactatagcttaacattgaatttgggtaattgatgtgtaggataggccggagactttgaagcaagagtgtgaattctaagtcctctccaaacaatatctataaaatcttacccaagtttacgaacattaacgtatccttgggtaagtttgtatatagacatacctactcttcagaagtgtatagctacttcctaaaacaagagaaagaaagaagccgagtctaacatcaggtagacaaggttgaactagtcctatagctcagttggttagagcgctacactgataatgtagaggtcggcagttcaactctgcctgggactactccgaacatattcaaatgcaatttaagcccgggtaaggttcctcgcgtatcatcgaattaaaccacatgttcctccgcttgtgcgggcccccgtcaattcctttgagtttcaccgttgccggcgtactccccaggtggaatacacgacatcgctccagaaaggaggtgttccagccgcaccttccggtacggctaccttgttacgacttagccccaattaccagttttaccctaggacgctccttgcggttacgtacttcaggtacccccggctttcatagtccaaagcctcggtaggccaataacgaaggtcgctcgcattgtcataatcccacttaccatttttgtacacgatcttcactccgtcatgttcaaattccgtgtcgttctttcccatgaaggcagtaccatccgccctggaacacttcaccctcccgtgaaaaggaatgcacccccttccttacctggtgcgtgtaaccttgttccctcatggctgcgacgatctggtttgccgccgtaaactgctcgtcctgcaatatccttttaagctcctgcaaaccgttctccctgtacccggccgggttcgcctcgtactttgtcaagtcgaaacgttccgttatgctttttagctgctcgtcagacagaggttgttcgaacgctttcaagagcctgtgttcaacctggaacccgttttcccatatccgggcgtttcacctgcgaacgtcaccgtcccactggctgcggcgtgtacggtagccgcatacaccgccgccatatccaggcctgcgtgaaactgcctttcaccgcttatcggatgcgtccggatacgaagtcaaattaagcgtagtggtatcctgagtagcgcgggacacgagaaatcttgcgtgaatctgccgggaccatccggtaaggctaaatactcccgagagaccgatagcgaaccagtactgtgaaggaaaggtgaggatattgcaggacgagcagtttacggcggcaaaccagatcgtcgcagccatgagggaacaaggttacacgcaccaggtaaggaagggggtgcattccttttcacgggagggtgaagtgttccaggttgaacacaggcccaccagacggtggaaacgttcggggtggtgataacgacggtacacaacatcaaaggcacaaaccgggtagccctgacgctcaacccctgggcgatccctttcctgctctactacggtacgggtgtcggcggtacaaggtatatcctttacctgcaaaccgttctccctgtacccggccgggttcgcctcgtactttgtcaagtcgaaacgttccgttatgctttttagctgctcgtcagacagaggttgttcgaacgctttcaagagcctgtgttcatccgcagcgacaaggaggggatcttgtttaacgaacggctgtatcaaacaccgattcgaaaggacgtttgggacgcagataagaaacgcattccggcacgtaacatgattatcgtcgcatcgacgggtgggggaaagtcaggcaactgcgtataatgcccgttatcacaaggtgtgaagtcgggatttatacgcttcaacagcttaattgctggctcttcattgggatcttgtggtactagcttaccatgtatggcaaggtcaagaattttgctcttggctgaatgccgtgttctcaaagtattataatgataaggcctattttgatgcggtgcagaacggggcggtctataaatgcgagatagacagcatccagacgatcgccggggacaatgagccgtacaaggtggctttcacttcctgtataaactggttaaagaaaaatcccgtcacgttctccggaaattgcggcgtggttctcacgatctcccctttcgtcctgataagaaaccttagcttctgccccgaaacgccgtaaatcgtcagggtggaagtgaaagccaaagaaaaatcccgtcacgttctccggaaattgcggcgtggttctcacgatctcccctttcgtcctgataagaaaccttagcttctgccccgaaacgccgtaaatcgtcagggtggaagtgaaagccaccttgtacggctcattatcgtcgcatcgacgggtgggggaaagtcggttacgtcgttgaacatcatccagcagaacatcgagcagaattataaacagatcgtcgtcgagttcggaaagagcttttaccagctttcgcagttgtacccggacaggtcgctgccaactggaacaggaagccagggaaaaccgggagaaggccgggaaactgcaaacggatctcgaaatagcccggcaggagaaaggaactccggccgtcggatgcaatacgcacaagatcctggagatcgtggagcgtatcgacgaggggagcgtatcgacgaggtgaagaagataccgacattcaacgatacggtttatgagatagaccgtaatacgctggatatgtgggtgaaaaggttaaaggacgaactaaagagataagcctatgtttgccaaagtacacccggccgatgcagaagcgtttcgtaaaagctctgcatatcgacgaactgcgagcgaagcggcactacgatataatcggctaaaggagaatagaaagccctgtcgccttgctgctcccgtatcgggcaaaaccagcttttcgcctccagcatggcttaacctggatcagaccaatttttcggacgtgaggccggaagaatgggaagcgttaagggagaagttcagagggggacaggcagagcagcccgacgggacaaccggagaggcgcaccccgaaatagatgccatgctggaggcgaaaaaaacaactgcctaaagacctctttaaccagcctgtcgtcgagatcaaatgcgacgaagccggggggaagaacaacaagagcaaagttctgaaagaggctatcgccatgatgcggaaaaacttttcctttcgctgggtgcatcccaataactttgccacggtgcgggtagtattcgactggaccaagatttccaatcatgacaagcctgaaggcatgagggtcgtattttatccgaccgatgatgaaagcaacacgtggatatttgatttccccggaggagaggatggggaagtggagctgtctggttatccggcgaccgaacatcacgcgtatcggcagtaaaaagcgtgtaactgccgttttctttccaaaccatcccgtcggtatcgtagttgaagcaaattacccggtaatcattctcggggagctccacttccccatcctctccgctggttttgcccgatacgggagcagcaaggcgacagggctttctattctcctttagccgattatatcgtagtgccgcttcgctcgcagttcgtcgatatgcagagcttttacgaaacgcttctgcatgaaatgggacattccacgggacatgacaatgggcaagcacgtatactgccagaaaccgttgactcactccgtttacgaatcccgtttgctgaccaagctggccgcctctaccggagtagttactcaaatgggtaatcagggagcatcgggcgaaggtaccgacctggtttgcgccgaggccgtcagtgcgttaagcgtgagcagcgacagcgagggaggacagtcgatcaggatataatcgaatttctccttttggcctttgataaggtgggctaagataagctcccgtccggcctcgttgattaactccgtttcaacggccgagcgcttaacgcactgacggcctcggatcggttgattatcccggttcaggctcaattcctggcaatgcgtggaatggccaaacttatgcaggtagtccacaaggtgcagcaacgtttgaactcggatctttcgatcgccggggttctgataacctattaccgaatactatgacgtacgtttaaagtatgaacgcttacaagaattgtctgcttacggtgacagatttgttttcataaaagacagtattgctaaaaaggaaattgttgagtctattttcactaactaccatcctcaggtagtcgtgaaaacttatgtacgtccgcaggtatcggccgagatcgggaagatcacgaacccggagcttaaaaggatattgcaggacgagcagtttacggcggcaaaccagatcgtcgcagccatgagggaacaaggttacacgcaccaggtaaggaagggggtacacgcaccaggtaaggaagggggtgcattccttttcacgggagggtgaagtgttccaggttgaacacaggctcttgaaagcgttcgaacaacctctgtctgacgagcagctaaaaagcataacggaacgtttcgacttgacaaagtacgaggcattccttttcacgggagggtgaagtgttccaggttgaacacaggctcttgaaagcgttcgaacaacctctgtctgacgagcagctaaaaagcataacggaacgtttcgacttgacaaagtacgaggcgaacccggccgggtacagggagaaccttcaccctcccgtgaaaaggaatgcacccccttccttacctggtgcgtgtaaccttgttccctcatggctgcgacgatctggtttgccgccgtaaactgctcgtcctgcaatatccttttaagctccgggttcgtgatcttcccgatctcggcacaagagaaagaaagaagccgagtctaacatcaggtagacaaggttgaactagtcctatagctcagttggttagagcgctacactgataatgtagaggtcggcagttcaactctgcctgggactacttcgagaaagaaaatgaaaacggcagtgatgtacaagccgactttggcggccgtacctacccggccgatccgcatcgccggaagcgacggggacgaaacggaagaaccggaagatccggacgagggggagagcaaaagcggaaagcggaagaaatacacctgtgggtgcggctgtaacgtgtggggaaattctggatgctcacaatagtgatatccggattattgccaagattgagaatcaggaaggggtggacaacatcgacgagattcttgaagtggcggacggcgtgatggtagcccgtggtgacctgggtatcgaagtgccgcaggaacgtattccgggactttatagtgggagctgttcattagccggactttcaatgccacactcttatcatcaataccatagatcagaatatgcatattcttcttattcagcatattcagcaggagttcataaaccagaatcaactgaatacggaagcctaccatggcaataaatcgaagtgccgcaggaacgtattccgggtatccagcgtgtgctgatccgcaaatgtatcctggcaaagaaaccggtgatcgttgcgactcagatgcttcataccatgatcaacaatcctcgtccgacccgcgcggaagtgaccgatatcgcgaatgccattttagagtttttgataaccccgttcacctgccggtacagatccaggctcttagtcagtatgtccctggattcccccagcacttgaaactgttcgtatgcctgtttaagttctttcgcccaggttatctgcgatagctgcgtcaaggccggatcctccatgatcttgttcagcacgttcgtatattccccgtatgcctcctgtccggtaaacacgtccgaccgggtgcactctttcgccgccagttccaacatttccccctgcatggaaagcacctgcaacaccattttagagtttttgataaccccgttcacagacggcagataactgttgcttaagaagagaagggggaagaacatcgagaagagacagagaacgggtcaaaacagcctgttttctttcttcgtcttccggattggcgtacatcgacacattatatccctgaaggatggccaaacacagggtagcatcctggaccctgagcttcatggacaagttcgcggatcgtgttcagtttaccgctgagctggtagataccgggacgatagacagcgccacggatttccagtttgtttgtgaagcggttaaggatggcttcggctgttacaacgtcaccgttacgcattgtgtagatgccaaactcgatcgcctttcccgtcgtgcttaacgtcaccttttcgacggccagttcttcatcgcttagaatcaccgggcttgcgaggctttcccccgtcgccccgtctttcaactgcgtaccgttggcgactaccacgaccgacttaatgaagctgcggaaatcagctctgcatatcgacgaactgcgagcgaagcggcactacgatataatcggctaaaggagaatagaaagccctgtcgccttgctgctcccgtatcgggcaaaaccagcttttcgcctccagcatggcatctatttcggggtgcgcctctccggttgtcccgtcctccttcccgtcccggaaaacaaggctctttttctcgatctcctttccgtttttgtaaacggtcactacccactgcatcggctcgttcacaacgccgtcctctccgtccacgacaccaccggaaacggcaaactcgatcgcctttcccgtcgtgcttaacgtcaaccgggtagccctgacgctcaacccctgggcgatccctttcctgctctactacggtacgggtgtcggcggtacaaggtacgggaagaacatcgccttaaccctccggggcaattacaccaagcggctctacaagatcatttgcagccaacgggacagacgggagagagtgtaatggcataagggcgcttgactgggagacttacaagtcgatcaggtaggaaactagagcatagtgatccggtgtttccgtatggaagggacatcgctcaaaggataaaaggtactccggggataacaggctgatccctcccaagagctcatatcgacgagcatctaagtacgaagccagccacaagattagatttcttagggtcgttaaagacgatgacgttgataggatgcaggtgtaaaggtggtaacatcaaagccgagcattactaattgcccgttcactttctttcggacggtgcggatcgcgatatatacgtttagcctacaagatcatttgcagccaacgggacagacgggagtattattactcgatcgaccaattctgcaaagacctggagatcccggcctcctactcgaatgcacagatcgaccaaaaggttttaaggcctgcacagacacgaatcaaggaaagcgaggccgatgtatgctccgcaccgctttacgtaagacaaattcatccggtttacctccgtacgctctttcagttcaaagcctttcagataaatctgcgtagtcttgatggacttatgaccaagcgactcgctgatcatctcgatagggacaccacggtacttggcagtagtagcccacggaaacgccgaagaaggaagagcctgaaaggacagtaggacgtttcttttcgggggaagaaccggagaacaagggaaacacgatagaggccattgtgtcgggcgatcagaagatcacgaacgggagcgtgataaaacttgtcacgctccaagaaatgcaactgcccgtgcttctgcattttcgaaattccattctccatcatcggttaagtaagtttgaaagaaagtaagcaagggcgcatggcggatgccttggctctcggaggcgatgaaggacgtgataagctgcgataagctctgggtaggtgcaaataacctttgatccagagatttccatctccaggtctttgcagaattggtcgatcgagtaataatactcccgtctgtcccgttggctgcaaatgatcttgtagagccgcttggtgtaattgccccggagggttaaggcgatgttcttcccgtaccttgtaccgccgacacccgtaccgtagtagagcaggaaaatctccaggtctttgcagaattggtcgatcgagtaataatactcccgtctgtcccgttggctgcaaatgatcttgtagagccgcttggtgtaattgccccggagggttaaggcgatgttcttcccgtcccttgtaccgccgacacccgtaccgtagtagagcaggaaaatctccaggtctttgcagaattggtcgatcgagtaataatcctcccgtctgtcccgttggctgcaaatgatcttgtagagccgcttggtgtaattgccccggagggttaaggcgatgttcttcccgtaccttgtaccgccgacacccgtaccgtagtagagcaggaaaatctccaggtctttgcagaattggtcgatcgagtaataatcctcccgtctgtcccgttggctgcaaatgatcttgtagagccgcttggtgtaattgccccggagggttaaggcgatgttcttcccgtcccttgtaccgccgacacccgtaccgtagtagagcaggaaaagcctccgaaacgttcaattagtacgcaacggaaagaatatcgccaccatcgacgtctacgaatttatcatgaaaggcaacacacaggatgacatccgccttcaggaaggtgacgtcgtgattgttcccgcttatgatgtattggtaaagatcagcggcaaggtaaaaccagggacatactgactaagagcctggatctgtaccggcaggtgaacggggttatcaaaaactctaaaatggtgttgcaggtgctttccatgcagggggaaatgttggaactggcggcgaaagagtgcacccggtcggacgtgtttaccggacaggaggcatacggggaaaaatctcattgccttcacccatcgtagcagcttccattaccaggcgacaagcttcggggatagtcataaagaaacgaatgatatcggggtgagtcactgtgacaggaccgccattctcaatctgttccttaaaacggggaattacagaaccgttactacccaagacgttaccaccaccccgaaaacggccgtccccttgttaatcaccatgccgccgggcagttgcatttcttggagcgtgacaagttttatcacgctcccgttcgtgatcttctgatcgcccgacacaatggcctctatcgtgtttcccttgttctccggttcttcccccgaaaagaaacgaacggaacccagtacgaaagaaaccagcaggaagaacccaagcacaacggaacccagtacgaaagaaaccagcaggaagaacccaagcacaacggaacccagtacgaaagaaaccagcaggaagaacccaagcacaacggaacccagtacgaaagaaaccagcaggaagaaaggaacagttaaggcagaaccagagagccgacagtctgaaagcggccgcagccatgaaacggagaacggcgaaagcccggccgaaaaaggaaacgccgaagaaggaagagcctgaaaggacagtaggacgtttcttttcgggggaagaaccggagaacaagggaaacacgataaccccctggatgctccagaatctcacccccgccggaacattcttcctgttcgcagtcatgtgcgtgccgtatatgctcatcgtatggaaactcgtgccggagaccacaggaaagtcactggaagagattgaaagatactggacccggtcggaacagtagaagaaagaaaagaggccattgtgtcgggcgatcagaagatcacgaacgggagcgtgataaaacttgtcacgctccaagaaatgcaactgcccggcggcatggtgattaacaaggggacggccgttttcggggtggtgaagctcgcacaggacaggatcaatataacggttgaatccgtccggcgctcccgttcgtgatcttctgatcgcccgacacaatggcctctatcgtgtttcccttgttctccggttcttcccccgaaaagaaacgtcctactgtcctttcaggctcttccttcttcggcgtttcctttttcggccgggctttcgccgttctccgtttcatggctgcggcccattgaccaatattcctcactgctgcctcccgtaggagtttggaccgtgtctcagttccaatgtgggggaccttcctctcagaacccctatccatcgaaggtttggtgagccgttacctcaccaactgcctaatggaacgcatccccatcgataaccgaaattctttaataacccttccattttcgaaaacgcaggactttcaggaggagattctttgttttaccaagttctcgtaggactagtcaacactctgaccaccgttcttgctcttgtgatcattgacagggtcggccgcaagaaactggtctattacggagtttcgggtatggttgtctccctcctgccccttccattttcgaaaacgcaggactttcaggaggagattctttgttttaccaagttctcgtaggactagtcaacactctgaccaccgttcttgctcttgtgatcattgacagggtcggccgcaagcaactggtctattacggagtttcggggatggttgtctccctcctgcgattttctctgcatatatttaacagtcaaagcgacaaacttgcgttttttaccaagttctcgtaggactagtcaacactctgaccaccgttcttgctcttgtgatcattgacagggtcggccgcaagaaactggtctattacggagtttcgggtatggttgtctccctcctgcgattttctctgcatatatttaacagtcaaagcgacaaacttgcgttttttaccaagttctcgtaggactagtcaacactctgaccaccgttcttgctcttgtgatcattgacagggtcggccgcaagcaactggtctattacggagtttcggggatggttgtctccctcctgcaaatattaattttgctgacacagtttaattgaattctctttttgctgttcatttgctttatttcaggacttcgcccttctcgttgaagaacacttcgctgtccgtgccttctgcatcggtaaatgtcaccttgtaggtctttgtgccttcctcgctttcctcaactgcggcttcctgccgcttggtgtaattgccccggagggttaaggcgatgttcttcccgtaccttgtaccgccgacacccgtaccgtagtagagcaggaaagggatcgcccaggggttgagcgtcagggctacccggtttgtgcctttgatgttgtgtaccgtcgttatcaccaccccgaacgtttccaagtaagtttgaaagaaagtaagcaagggcgcatggcggatgccttggctctcggaggcgatgaaggacgtgataagctgcgataagctctgggtaggtgcaaataacctttgatccagagatttccgaatgggacaacccggcattctgaaggaatgtcatccatctttgatggaacgggaagaacatcgccttaaccctccggggcaattacaccaagcggctctacaagatcatttgcagccaacgggacagacgggagtattattactcgatcgaccaattctgcaaagacctggagatcccggcctcctactcgaatgcacagatcgaccaaaaggttttaaggcctcgccggcaacatggtatcggatgttgagattgtggtaatggtgaacgattataagccaatcgaggtaaaggatctgccgcaggcggttcaggacacgatcaagaaggatttcgcagacctgacaatcaaggaagccgcagttgaggaaagcgaggaaggcacaaagacctacaaggagtaccgcttccatactcatccatgcaggtataacttatcttttggacatccttggtggcttcccaactataaaacgccatcatgtcttcactaaccgttccgggattgaacgcgtaaaagtccaaagcctcggtaggccaataacgaaggtcgctcgcattgtcataatcccacttttcctctgatccgaacgggtgcgcaagatcccggttcaatcgggtggggtgtcccgtggaatgtcccatttcatgcagaagcgtttcgtaaaagctctgcatatcgacgaactgcgagcgaagcggcactacgatataatcggctaaaggagaatagaaagccctgtcgccttgctgcgtgtcccgcgctactcaggataccactacgcttaatttgacttcgtataccggactatcaccgtctatggttcaactttccagaggattctactcatcaaatgtcttgcgacatcgtggtcctacaaccccacacatgccgtaacatgggtggtttgggctattccccgttcgctccctcggtaggccaataacgaaggtcgctcgcattgtcataatcccacttaccatttttgtacacgatcttcactccgtcatgttcaaattccgtgtcgttctttcccatgaaggcagtaccatccgccgtaaaagcgaacacgtcgaaatcggtgttcttcaagttggtgttggtagaggtacccgtaccgcaaacggacacacgtagtcgggttgaatatactaaggcgcttgagtgattcacggttaaggaactaggcaaattgaccctgtaacttcgggataaagggtcccaacgagagttgggcgcagagaataggtccaggcaactgtttaacaaaaacacagggctgtgcggttatcctaccaaggtggaaggttcttctactttattactgagtgcctgcgctcctcaggcccaacacgtgaagatgattttccccgcccgcgacaatatgccgaaagttgccttgccggaagttgaggtacactggtatgacggcggtatgatgccggaacgtccgaaaggtttcccccgttatgctttttagctgctcgtcagacagaggttgttcgaacgctttcaagagcctgtgttcaacctggaacacttcaccctcccgtgaaaaggaatgcacccccttccttacctggtgcgtgtaaccttgttccctcatggctgcgacgatctggtttgccgccgtaaactgctcgtcacctgggcgaaagaacttaaacaggcatacgaacagtttcaagtgctgggggaatccagggacatactgactaagagcctggatctgtaccggcaggtgaacggggttatcaaaaactctaaaatggtgttgcaggtgctttccatgcagggggaaatgttggaactggcggcgaaagagtgcgcgttacgtcaaaaagggtacaaggttcttttgatcgaccttgacgggcaggccaacctgaccgaatcgctgggcttctctgcggagcttccccaaacgatctacggtgcgatgaaaggcgaatacgacctgccgatctacgagcataaggacggccttagcgtcgttccctcctgcctggatatgctcaccgagggcgatatgatcgtccggatcaggtcaaaggaaagcacgctttcctccatgatcttgttcagcacgttcgtatattccccgtatgcctcctgtccggtaaacacgtccgaccgggtgcactctttcgccgccagttccaacatttccccctgcatggaaagcacctgcaacaactatttcctgcccgatatgtcgagcatacggccggacactatctatctgaatgaggtgtcgcaaacgcacctgatcgcaccggaaaaggtgatttatatagattacggcgatacctgcatacaggtaagcaaggccgagaataccgagaatatcgtgcgaatgatcgcagccacgggaaaggaagcaaggccgagaataccgagaatatcgtgcgaatgatcgcagccacgggaaaggtggaggaatttcccaggcagacaaacgtgtcgctggcgaccgaaggggggaagttctacacgttcaacgtggattatcggcagcagccggaggcgttcgtctatgagataggggagaaacggccggagcctgccgatctacgagcataaggacggccttagcgtcgttccctcctgcctggatctctcggccgttgaaacggagttaatcaacgaggccggacgggagcttatcttagcccaccttatcaaaggccaaaaggagaaattcgattatatcctgatcgactgtcctccctcgctgtcgctgctcccagaaagtagaagaacggcactttgttcgccagcgtgaaacgccgggacgaaatggaaagcatgagcgatataaccggggaaatcaggttttcgatctgataggcgttcgatacgacaaccaatttcggacattccggatctatcaggttaaagtcgaaatcatttccggaaaggacataacacatgcgaagaaatactgggattaccgcaagatgtacgatgaaatgggcaaatccattgacggcgtaatcattgctaccgccgaccatactcatgccatcatcacggcagacgctatgacaatgggcaaacacgtatattgccagaaaccgttgactcactccgtttacgaatcccgtttgctgaccaaactgcctgtttcctgtcgttcagacgcaggaaggtagcggattgagccttgtcccggcaacaagtgccgggcagagcgaaaccgcaccgggcattgaaaacgactgagtacacaccgcatgggctactaccgcataggctgtcgcttgtggtccggcttgccggggtgtgagcgggagccggagccgaactgcctgtttcctgtcgttcagacgcaggaaggtagcggattgagccttgtcccggcaacaagtgccgggcagagcgaaaccgcaccgggcattgaaaacgactgagtacacaccgcatgggctaccatcgcataggctgtcgcttgtggcccggattgccggattgctatcacacacctggcaggatcctgccaggtgtgtgatagcaatccggcaatccgggccacaagcgacagcctatgcgatggtagcccatgcggtgtgtactcagtcgttttcaatgcccggtgcggtttcgctctgcccggcactttctgccgggacaatgctcaatccgctaccttctttcgtctgaacgacaggaaacaggctactcggctccggctcccgctcacaccccggcaagccggaccacaagcgacagcctatgcggtagtagcccatgcggtgtgtactcagtcgttttcaatgcccggtgcggtttcgctctgcccggcactttctgccgggacaatgctcaatccgctaccttctttcgtctgaacgacaggaaacaggctacattaagcgtagtggtatcctgagtagcgcgggacacgagaaatcttgcgtgaatctgccgggaccatccggtaaggctaaatactcccgagagaccgatagcgaaccagtactgtgaaggaaaggtgaaaagcacttcgaatagaagagtgaaatagtccctgaaaccgtgcgcctacaagcggtcggagcaaacctcctcacgaaatgcgattggttttaacgtgttaagtaatgcggcggaaacgagggctacccctactaccaacaccaacttgaagaacaccgatttcgacgtgttcgcttttacggcggatggtactgccttcatgggaaagaacgacacggaatttgaacatgacggagtgaagatcgtgtacaaaaatggccttggtggcttcccaactataaaacgccatcatgtcttcactaaccgttccgggattgaacgcgtaaaagtccaaagcctcggtaggccaataacgaaggtcgctcgcattgtcataatcccacttaccatttttgtacacgatcttcactccgtcatgttcaaattccgtgtcgttctttcccatgaaggcagtctttgccctggaatgtttcctgtaccagttccgaaacgctcttgttcaggttctttcttccgtcgtactgggttatcagaaccccggcgatcgaaagatccgagttcaaacgttgctgcaccttgtggactacctgcataagtttggccattccacgcattgccaggaattgagcctgaaccgggataatcaaccgagtgtcgcaaacgcacctgatcgcaccggaaaaggtgatttatatagattacggcgatacctgcatacaggtaagcaaggccgagaataccgagaatatcgtgcgaatgatcgcagccacgggaaaggtggaggaatttcccaggcagacaaacgtgtcgctggcgaccgaaggggggaagttctacacgttcaacgtgataccttattaataggtcgtgtagcagacttgtcagtttatgtatgccgtgctgactacactcataaggcggaatatacattgatcaatgaactgtcttttgagaagaagctgcctaatctttgtaccgtcatcaacggcgtagacctgaagaagcgaaaatatggttattactacggctacggtaagtatggcaaaccgtattcgcctttcatcgcaccgtagatcgtttggggaagctccgcagagaagcccagcgattcggtcaggttggcctgcccgtcaaggtcgatcaaaagaaccttgtaccctttttgacgtaacgcaccgcccaggttgatcgtggttgtggtctttcctactccccccttgtgattcaatacggagattacttttgcgcctttgataaggtgggctaagataagctcccgtccggcctcgttgattaactccgtttcaacggccgagagatccaggcaggagggaacgacgctaaggccgtccttatgctcgtagatcggcaggtcgtattcgcctttcatcgcaccgtagatcgtttggggaagctccgcagagaagcccagcgattcggtcaggccactactaggggaatcattattattttcttttcctgcaggtactaagatgtttcagttccctgcgttagcctccatcaaagatggatgacattccttcagaatgccgggttgtcccattcggaaatctctggatcaaaggttatttgcacctacccagagcttatcgcagcttatcacgtccttcatcgcctccgagactacgatataatcggctaaaggagaatagaaagccctgtcgccttgctgctcccgtatcgggcaaaaccagcttttcgcctccagcatggcatctatttcggggtgcgcctctccggttgtcccgtcgggctgctctgcctgtccccctctgaacttctcccttaacgcttcccattcttccggcctcacgtccgaaaaacgcaaaccaggtcggtaccttcgcccgatgctccctgattacccatttgagtaactactccggtagaggcggccagcttggtcagcaaacgggattcgtaaacggagtgagtcaacggtttctggcaatatacgtgtttgcccattgtcatagcgtctgccgtgatgatggcatgagtatggtcggcggtagcaatgattacgcacagtactggttcgctatcggtctctcgggagtatttagccttaccggatggtcccggcagattcacgcaagatttctcgtgtcccgcgctactcaggataccactacgcttaatttgacttcgtataccggactatcaccgtctatggttcaactttccagaggattctactcatcaaatgtcttgcgacatcgtggtcctacaatggaagctaacgcagggaactgaaacatcttagtacctgtaggaaaagaaaataataatgattcccctagtagtggcgagcgaacggggaatagcccaaaccacccatgttacggcatgtgtggggttgtaggaccacgatgtcgcaagacatttgatgagtagaatcctctggaaagttgaaccatagacggtgatagtccgggcgtatatgttcggctatcccgaaaaacattcctgccagggctgcggcgaactcggccgttaattcctccttgccgtattcctctgatccgaacgggtgcgcaagatcccggttcaatcgggtggggtgtcccgtggaatgtcccatttcatgcagaagcgtttcgtaaaagctctgcatatcgacgaactgcgagcgaagcggcatcataattcgcaatgggctgacaagatgatccaggtcggactgatgccgtccgacaccggggaggccggaggcaaaaggacaggccagagcattacgcattatatcattccgggagggaagttcgagcaggttttcaatacgctaagccgggaggatctgcaaaacttgcggcttaggtacaagccgactttggcggccgtacctcatttgctttatttcaggacttcgcccttctcgttgaagaacacttcgctgtccgtgccttctgcatcggtaaatgtcaccttgtaggtctttgtgccttcctcgctttcctcaactgcggcttccttgattgtcaggtctgcgaaatccttcttgatcgtgtcctgaaccgcctgcggcagatcctttacctcgattggcttatatcattgtagcccaggctcaaagcgatttcggcacggagggccttgacggtctccatagtgatgcgccacccgccttcggggaggttgtgtaaaaagtaagaatcaagtgttctttgacatattgtattaaaaaggcaatgctctttatctctttattttggtatttctattgttgtcctttggcgaatgaccgctattaggtatacttaaggtagtacaggaatattaacctgttctgccatcggcctcaccgttcggctgagccttaggacccgactaaccctgatccgattagcgttgatcaggaaaccttagtctttcggcgagggggtttctcaccccctttatcgttacttatacctacatttgcttttccacacgctccagcaaagctcacgcttcaccttcgacgccgagaaacaaataccgattactctgaattggaagaacagctcaataatcttgtggaagcattgtatcaatgacatattgttgaccctcaaaagagggcttcgatattgtcattggcaatccaccgtacggagcgaaatacgacaaccaaacaaagaggtattataagaatacctatgtgacggcaaatagcatccgaggattacagaacgaagacctgatcaccacgggcaaggtcctgagtagtcggatgatcctccagcatatcggaagtattcttcttagtctcttcacgcaggcgggattcgttgatgtccgtgcccgttgatttcgaggtgtttacattgttctgctgctcgtatagctgcttcacacgcattgcctgttctttggttacccccttacgggctagttcggaagcaaacgggaagaacatcgccttaaccctccggggcaattacaccaagcggctctacaagatcatttgcagccaacgggacagacgggaggattattactcgatcgaccaattctgcaaagacctggagatcccggcctcctactcgaatgcacagatcgaccaaaaggttttaaggcctgcacagacacgaatcaaggaaagcgaggccgatgtatgctcccgtctgtcccgttggctgcaaatgatcttgtagagccgcttggtgtaattgccccggagggttaaggcgatgttcttcccgtcccttgtaccgccgacacccgtaccgtagtagagcaggaaagggatcgcccaggggttgagcgtcagggctacccggtttgtgcctttgatgttgtgtaccgtcgttatcaccaccccgaacgtttccagagtgagggaaatacaaaaatacagcaaaatccatataaaaaagaatcaatggcatgggcagcatggattattgcaaggttaggagcatggagtgcatacaagagccagtccattccaggatatattacctttaagaatggactggatagattttatacacagtttgaactgtatgagttaatcagctaagacttgtgtataaagggtagcttccgacaagcttcggggatagtcataaagaaacgaatgatatcggggtgagtcactgtgacaggaccgccattctcaatctgttccttaaaacggggaattacagaaccgttactacccaagacgttaccaaagcgggtagtgataaatttggtatggccttttacttttccctcacggatagcacatcccagactctgtacatagatttcggccaaaagagtcatcataagctgtcgattctacaatataagctgtagactgttcataacctataatttggtcaagcctacaaaacgtccatccatcaggcaactgcgtataatgcccgttatcacaaggtgtgaagtcgggatttatacgcttcaacagcttaattgctggctcttcattgggatcttgtggtactagcttaccatgtatggcaaggtcaagacctcctgctcatgggatgcccagaaagagcaaaaaataaccattggtgtatatcgtttgaccatgaagtccaattctgacaacttccgtcagagtgccattcaagggattatgaagcgtatcaaggcgaagggtgctactattgtgattttcgagcctactatgcaagatggtgaaacattctttggtagccaagtggtcaataacttaatcaaattcacctcctgctcatgggatgcccagaaagagcaaaaaataaccattggtgtatatcgtttgaccatgaagtccaattctgacaacttccgtcagagtgccattcaagggattatgaagcgtatcaaggcaaagggggctactattgtgattttcgagcccactatgcaagatggtgaaactttctttggaagtcaagtgatcaataatctggtcgagtttacctcctgttcatgggatgcccagaaagagcaaaaaataaccattggtgtatatcgtttgaccatgaagtccaattctgacaacttccgtcaaagtgccattcaagggattatgaagcgtatcaaggcgaagggtgctactattgtgattttcgagcctactatgcaagatggtgaaacattctttggtagccaagtggtcaataacttaatcaaattcacctcctgttcatgggatgcccagaaagagcaaaaaataaccattggtgtatatcgtttgaccatgaagtccaattctgacaacttccgtcaaagtgccattcaagggattatgaagcgtatcaaggcaaagggggctactattgtgattttcgagcccactatgcaagatggtgaaactttctttggaagtcaagtgatcaataatctggtcgagtttagatctcctttccgtttttgtaaacggtcactacccactgcatcggctcgttcacaacgccgtcctctccgtccacgacaccaccggaaacggcaaactcgatcgcctttcccgtcgtgcttaacgtcaccttttcgacggccagttcttcatcgcttagaatcaccgggcttgcgaggctttcccccgtcgccccgtctttcaactgcgtaccgttggcaagatccccagggatgcgaacaggattatttttgttttcgtggccttatccatagtgttactttttttcaggttcttgttctatccggacaatctgctgtataaactggttaaagaaaaatcccgtcacgttctccggaaattgcggcgtggttctcacgatctcccctttcgtcctgataagaaaccttagcttctgccccgaaacgccgtaaatcgtcagggccgtgtctcttgagcggaaacgaaaagaacggaacacgataaaaaagaaaggagaattaccttgaaaagtcttaaatataggtttctacacacactcgtgtgtgtgtgtgtgtgtgtgtgtgtgtgtttataaaaaaaatcaatatttccaacttttttctgttttttttgcatataacttactataaaatatctgctaccccagaaagagcaactaaccaaaacgttctccggaaattgcggcgtggttctcacgatctcccctttcgtcctgataagaaaccttagcttctgccccgaaacgccgtaaatcgtcagggtggaagtgaaagccaccttgtacggctcattgtccccggcgatcgtctggatgctgtctatctcgcatttatagaccgccccgttctgcaccgcatcaaaataggccttatcattataatactttgagacaactgcgaaagctggtaaaagctctttccgaactcgacgacgatctgtttataattctgctcgatgttctgctggatgatgttcaacgacgtaaccgactttcccccacccgtcgatgcgacgataatcatgttacgtgccggaatgcgtttcttatctgcgtcccaaacgtcctttcgaatcggtgtttgatacagccgttcgttaaacaagatcccctcctcggacgaggattgttgatcatggtatgaagcatctgagtcgcaacgatcaccggtttctttgccaggatacatttgcggatcagcacacgctggatacccggaatacgttcctgcggcacttcgatacccaggtcaccacgggctaccatcacgccgtccgccacttcaagaatctcgtcgatgttgtccaccccttcctgattctcaatcttggcaataatcccccggccgatccgcatcgccggaagcgacggggacgaaacggaagaaccggaagatccggacgagggggagagcaaaagcggaaagcggaagaaatacacctgtgggtgcggctgtaacgtgtggggaaaatccgggctggtgttaaggtgcggactgtgcgacactgattttacggaacaataggaaacagtgcaaaggtcagaagcccccagtaaaaaccccgcgtatttcttccgctttccgcttttgctctccccctcgtccggatcttccggttcttccgtttcgtccccgtcgcttccggcgatgcggatcggccgggtaggtacggccgccaaagtcggcttgtacctaagccgcaagttttgcagatcctcccggcttagcgtattgaaaacctgctcgaacttccctcccggaatgatataatgcgtaatgctctggcctgtctcccgtgtctcttgagcggaaacgaaaagaacggaacacgataaaaaagaaaggagaattaccttgaaaagtcttaaatataggtttctacacacactcgtgtgtgtgtgtgtgtgtgtgtgtgtgtttataaaaaaaatcaatatttccaacttttttctgttttttttgcatataacttactataaaatatctgctaccccagaaagagcaactaaccaaaaacttttggttagttgctctttctggggtagcagatattttatagtaagttatatgcaaaaaaaacagaaaaaagttggaaatattgattttttttataaacacacacacacacacacacacacacacacacgagtgtgtgtagaaacctatatttaagacttttcaaggtaattctcctttcttttttatcgtgttccgttcttttcgtttccgctcaagagacacggacacgtaatgaacgggtgtaggcatcggcttcaaagccgccggcatatttgattaaagtggcaaggttctcttctttcttcatttcaaaacgcataggacgttttaccttgccgctgatctttaccaatacatcataagcgggaacaatcacgacgtcaccttcctgaaggcggatgtcatcctgtgtgttgcctttcatgataaattcgtagacgtcgatggtggcaacgaggccggacgggagcttatcttagcccaccttatcaaaggccaaaaggagaaattcgattatatcctgatcgactgtcctccctcgctgtcgctgctcacgcttaacgcactgacggcctcggatcggttgattatcccggttcaggctcaattcctggcaatgcgtggaatggccaaacttatgcaggtagtccacaaggtgcagcaacgtttgaactcggatcttcttgaccttgccatacatggtaagctagtaccacaagatcccaatgaagagccagcaattaagctgttgaagcgtataaatcccgacttcacaccttgtgataacgggcattatacgcagttgcctaatggatggactgttgcacctatgcaagtactatgctctttggttgatggtgataagcaaaaaggaatagaacgaataaatcttgatgtcaaatatttgcgtggtttcgactggaccaagatttccaatcatgacaagcctgaaggcatgagggtcgtattttatccgaccgatgatgaaagcaacacgtggatatttgatttccccggaggagaggatggggaagtggagctccccgagaatgattaccgggtaatttgcttcaactacgataccgacgggatggtttggaaagaaaacggcagttacacgctttttactgccgatacgcgtgatgaaccaagagcaagattcttgatcttgccattcacggaaaacttgtgccgcaagacccaaacgatgaacctgctatcgaattgttgaaacgtataaatcccgactttacaccttgtgataacgggcattatacgcagttgcctgatggatggacgttttgtaggcttgaccaaattataggttatgaacagtctacagcttatattgtagaatcgacagcttatgatgactcttaaccaagagcaagattcttgatcttgccattcacggaaaacttgtgccgcaagacccaaacgatgaacctgctatcgaattgttgaaacgtataaatcccgactttacaccttgtgataacgggcatagtgggaagttaccttataaaatacctaagacatgggcatggtgtagtcataattctatcttagatatatctggaggatcacaacctgcgaagagttattttgaaaagccaagagcaaaattcttgaccttgccatacatggtaagctagtaccacaagatcccaatgaagagccagcaattaagctgttgaagcgtataaatcccgacttcacaccttgtgataacgggcatagtgggaagttaccttataaaatacctaagacatgggcatggtgtagtcataattctatcttagatatatctggaggatcacaacctgcgaagagttattttgaaattcatgttcagatacattttttttcaaattcagggttaaatcgaaaaaaagtaggtttttatttgtttaatacatgtgtttttgtctatctttgcgtcaaatttaaatccgttacctaagaagtaacacaccagcatcagtgctgattatcaaatttttaaccattcaaattcgacctaaagggcaagtcttcacgtaatgcaaattcttacgatttacctctgtacgctctttaaagagcgtacagaggtaaatcgtaagaatttgcattacgtgaagacttgccctttaggtcgaatttgaatggttaaaaatttgataatcagcactgatgctggtgtgttacttcttaggtaacggaaaagtacacttcataataaatcgggaggaaaaagtcgaaaagtaccgactaatgagggttgagagcatcttggctttagagaaagtagagattcttaggaaaattggataccagcgttttgagtgtgctacgccttcccctgtcccataaataggcccagcatttagtgatttctcttttgttaaaatcatacttttttaccccatgtttttccgttacttcttaggtaacggatttaaatttgacgcaaagatagacaaaaacacatgtattaaacaaataaaaacctactttttttcgatttaaccctgaatttgaaaaaaaatgtatctgaacatgaaataccagcgttttgagtgtgctacgccttcccctgtcccataaataggcccagcatttagtgatttctcttttgttaaaatcatacttttttaccccatgtttttccgttacttcttaggtaacggaaaagtacacttcataataaatcgggaggaaaaagtcgaaaagtaccgactaatgagggttgagagcatcttggctttagagaaagtagagattcttaggaaaattggccaattaccgtcttggtcccggtgatgaagtcatcattgatatctggggtgcgagccagaacacgatccgccagcaaatctctcctgaaggtactatcaacattcagaagatcggccctgtcaaccttagcggtatgacagtctctgccgccaatgactatctgaagaacgccctgaataaaatatataacggtctgaacaacacgaccgatccaacttccgacatccgtctgacagggaaaaccgggagaaggccgggaaactgcaaacggatctcgaaatagcccggcaggagaaaggaactccggccgtcggatgcaatacgcacaagatcctggagatcgtggagcgtatcgacgaggtgaagaagataccgacattcaacgatacggtttatgagatagaccgtaatacgctggatatgtgggtgaaaaggttaaaggacgaactaaagagataagcctatgtttgcgggggaaagtcggttacgtcgttgaacatcatccagcagaacatcgagcagaattataaacagatcgtcgtcgagttcggaaagagcttttaccagctttcgcagttgtacccggacaggtcgctgcatattgattatgacggcagcagcccgttggggatcaatccgttctatacggccgggaagcagccggacaacgagaagataaagacgcttgtaaacctggtgcttaaattcttcagattaatgtgatgggagaagtcgtacagcccggtacctacgccctttcttccttctctaccgtcttccatgcgctttatcgtgcaggcggtgtgagtgatatcggtagcctccgaaacgttcaattagtacgcaacggaaagaatatcgccaccatcgacgtctacgaatttatcatgaaaggcaacacacaggatgacatccgccttcaggaaggtgacgtcgtgattgttcatgcgaagaaatactgggattaccgcaagatgtacgatgaaatgggcaaatccattgacggcgtaatcattgctaccgccgaccatactcatgccatcatcacggcagacgctatgacaatgggcaagcacgtatactgccagaaaccgttgactcactccgtttacgaatcccgtttgctgaccaagctggccgcctctaccggagtagttactcaaatgggtaatcagggagcatcggctttataatatctttataggctcgatcatcggccgggaaaacaacctgaatccggactacctgtttctttcggatctgcattcgtcgctctgcatggggatcaattactctacgttccgcagcgacaaggaggggatcttgtttaacgaacggctgtatcaaacaccgattcgaaaggacgtttgggacgcagataagaaacgcattccggcacgtaacatgattatcgtcgcatcgacgggatgcccgttatcacaaggtgtaaagtcgggatttatacgtttcaacaattcgatagcaggttcatcgtttgggtcttgcggcacaagttttccgtgaatggcaagatcaagaatcttgctcttggtttgctttatgatggtttgcaaatttactttgctatgttctatttggtcgattaaagcaaacaatttctctatttccattacaatgcgctgttgctcactaagaggtggtaaaggaaagcacacaagctattgatattcaaccatacagcatacctaccactccggctttcagccactcttccttcctgaagaggggagtttagttacttttgacacaccttcataaagccagatgtactgtccggggtatatttatgataattcaacggtaggattgtgaatggttaagccaccgtctaccacaatcgtctgtccggtgatgtatcgtgcatcgttggaggccaggaatgcaatagtgctgaggttgtccattccttccagcacggcttcgtccgtaagtgacgagatccatagacggcggtaggatttcctgcattccagataccggtaaaggtacctgaacaccatttccccctcccgggagggggaaatggtgttcaggtacctttaccggtatctggaatgcaggaaatcctaccgccgtctatggatctcgtcacttacggacgaagccgtgctggaaggaatggacaacctcagatattgtaaagcaggaactcgttgaacaaggtattcatattgattttgaagatatggacttgtctgcaaacagtcagttcttcctctggcatacctggttccatgatgttttctcacgaccctcaaaagagggcttcgatattgtcattggcaatccaccgtacggagcgaaatacgacaaccaaacaaagaggtattataagaatacctatgtgacggcaaatagcatccgaggattacagaaactgaaccgttgtcataaccgtttcggctggtggggagacggggaaacgataaggcgggcattccaggacaggtcggtactgaaaaacgtaacagacagtgagacttatgactttaccccccccccacatgggagaactattacaggttgactgatgcaggcaaggggctaggactgacgcggagccaacataattatgaccggatgacactgctatatatcatggacaaaggttatccgagaagacccgaacgatgaacctgcatcagttctgctcgaacgaatcaaggctgaaaaagaacgactgataaaggaaggcaaaatcaagcggagcaagaagtctgcaaagacttccgatacgccacattatgagaacgtgccgtttgaaataccgaattcatgggtgtggacaacgattgaagaaatatgctcaaagataggttccggtagcacgccaaggggaagtaactattctgcgaacgggatcagacccgaacgatgaacctgcatcagttctgctcgaacgaatcaaggctgaaaaagaacgactgataaaggaaggcaaaatcaagcggagcaagaagtctgcaaagacttccgatacgccacattatcagaatgtgccgtttgaggtgccgagttcatgggtatggtgcaaattggaggattatgttaaaagtgtgactgatggcgatcatcaagcaccgcctaagtcagatattggcatcccacaaacggtaatcagtgaacaacccatatcctatttcaaggataaagaatatctatcattcaaggaggttgcaactttattggggctgagcaaacaagccgtatataaaatggtatatgccacattatgagaacgtgccgtttgaaataccgaattcatgggtgtggacaacgattgaagaaatatgctcaaagataggttccggtagcacgccaaggggaagtaactattctgcgaacgggatccaaacggtaatcagtgaacaacccatatcctatttcaaggataaagaatatctatcattcaaggaggttgcaactttattggggctgagcaaacaagccgtatataaaatggtatatgccacattatcagaatgtgccgtttgaggtgccgagttcatgggtatggtgcaaattggaggattatgttaaaagtgtgactgatggcgatcatcaagcaccgcctaagtcagatattggcatcccataatgcccgttatcacaaggtgtgaagtcgggatttatacgcttcaacagcttaattgctggctcttcattgggatcttgtggtactagcttaccatgtatggcaaggtcaagaattttgctcttggtttgctttatgatggtttgcaaatttactttgctatgttctatttggtcgattaaagcaaacaatttctctatttccattacaatgcgctgttgctcactaagaggtggtaaaggaatacagagctttttagtttctcccgcttgaaacttttgtttctcctgcttggaactaaagtttcatcggcttgaaactttagtttcaaagccgtgaaaccaaagttccggacgcttgaaaacagtggttccagccgatggaatgaatgaaacaaggcaggaaactgatcccttacttatatgattcaattaacttgaccgcaccaactgttcgattaacctgctcttccaagaaacaataaatcatctgtacttctgctacctccaactcttcgacatcccgaagcgtgaaaacgagtttctgctggggaggcagttcgttggtatatcgcaatatcagttctttcaactgcttgttggaaagagatatctctttccaacaagcagttgaaagaactgatattgcgatataccaacgaactgcctccccagcagaaactcgttttcacgcttcgggatgtcgaagagttggaggtagcagaagtacagaaactgaaccgttgtcataaccgtttcggctggtggggagacggggaaacgataaggcgggcattccaggacaggtcggtactgaaaaacgtaacagacagtgagacttatgactttacccccccccccacatgggagaactattacaggttgactgatgcaggcaaggggctaggactgacgcggagccaacataattatgaccggatgacactgctatatatcatggacaaaggttatccgagaatatattgccataaacacgagctcccccatcgatataaacagtagttcctgaggggacaaatagagtatcattaggaagattatgcacaccgggaccaaaataaatcaaattggaccctttttttttcttgagagccctttggatttctttatcggaaggacgaaatttatcaatcggattcgcaaaaagatgaagattgtgaaaaatatctccattgacctctactgagagattgcgaggacgcccacctcgtcggccgcctcctttgtcgcttccgccttgatgttcaagggcacatatataccgggcagtccgtccctgtcgtacacggtcttttgcatctcatagatgctgttcccgatccggacggattcaaccgttatattgatcctgtcctgtgcgagcttcaccaccccgaaaacggccgtccccttgttaatcaccatgccgccgggcagttgcatttcttggagcgtgacaagttttatcaatatattgccataaacacgagctcccccatcgatataaacagtagttcctgaggggacaaatagagtatcattaggaagattatgcacaccgggaccaaaataaatcaaattggacccttttttttcttgagagccctttggatttctttatcggaaggacgaaatttatcaatcggattcgcaaaaagatgaagattgtgaaaaatatctccattgacctctactgagagattgcgaggacgcgaagagtgacgtggagacggaggcgtgacagcgccgcggactgacggaatagtccgttgaagggtgtagatgctgatcatcccaggcaaatccgggatgagagtcgaacctgatagtatggaacgttccatactatcaggttcgactctcatcccggatttgcctgggatgatcagcatctacacccttcaacggactattccgtcagtccgcggcgctgtcacgcctccgtctccacgtcactcttataaagctatgctttagaagtcgtaaagcatagctttagccaatacaaaacgccctcgcagtctacaacacttattacctgttacctaatacttattacctgctcatggttcgcccaacgcatccacaatcacccttacctccagcggagtgtaagaacggtgctgcggctgataacctaaatcggacaggcgttcctgaagaccgggacagcggacaatccatttattcattttgcggtaagcggatatattgccataaacacgagctcccccatcgatataaacagtagttcctgaggggacaaatagagtatcattaggaagattatgcacaccgggaccaaaataaatcaaattggacccttttttttttcttgagagccctttggatttctttatcggaaggacgaaatttatcaatcggattcgcaaaaagatgaagattgtgaaaaatatctccattgacctctactgagagattgcgaggacgcaaagaaagaagccgagtctaacatcaggtagacaaggttgaactagtcctatagctcagttggttagagcgctacactgataatgtagaggtcggcagttcaactctgcctgggactactccgaacaaaaattgtcgttgtcaattcattattgcaatgttcaattactcttgggggattagctcagctggctagagcatctgccttgcacgcagagggtcaacggttcgaatccgttattctccacaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctattcccgaccagagcaacgttgatagtacggcgcttacctaacgccaaccgtttcatatcttcttcttttacagaaacatcttcgggcagaccttcgtgatatacagctttttcggcttgtttttttgcttcttcctcgctgactacctcaatcatttccgcttcctgacgacgaagagatatttcataacctaagactttatatttaatcgggtctttcagtggagcattcaacaatacttcaacaattcccgaccagagcaacgttgatagtacggcgcttacctaacgccaaccgtttcatatcttcttcttttacagaaacatcttcgggcagaccttcgtgatatacagctttttcggcttgttttttttgcttcttcctcgctgactacctcaatcatttccgcttcctgacgacgaagagatatttcataacctaagactttatatttaatcgggtctttcagtggagcattcaacaatacttcaacaaaggcgagatcacctttgacaaactcggttcgcaacaccctgccatcgaacccgattatgcttcggtacagtccgtacttcacagtatcgacttccctattctctacggatataacgtagtgaaaaaggaccatacggaatgtctatctttgccggtccaaaactccggtatctatggggaaagcagaacgaaatcactttcacaaacttcgaccagaaagggattcatgaaaagctgtatccgctcaaccccacacatgccgtaacatgggtggtttgggctattccccgttcgctcgccactactaggggaatcattattattttcttttcctacaggtactaagatgtttcagttccctgcgttagcttccatcaaagatggatgacattccttcagaatgccgggttgtcccattcggaaatctctggatcaaaggttatttgcacctacccagagcttatcgcagcttatcacgtccttcatcgcctccgagattgtcataatgacggaaatcaggaacggatctttctttatcttcgtcagctcaaagacgataaaatcccggttctgcatatcgttctccagtggggacggcttgcacacgttctcataaaatcccccggcataaattccgaacacacgtgcaggaagctgtctatatcgaagtattccggcaggatattcaaacgctcatacagttttttcccctctctttggacgtacctgtaaaagtccgggaaacaaaaataagtaaaccggaggcaggaataataaataataaagtaaacagctgccagggttagtaatatttctagtcaacacatagcagctattagagataaacaagtcaaccattattagggaagtacagagctttttagtttctcccgcttgaaacttttgtttctcctgcttggaactaaagtttcatcggcttgaaactttagtttcaaagccgtgaaaccaaagttccggacgcttgaaaacagtggtaaggcgagatcacctttgacaaactcggttcgcaacaccctgccatcgaacccgattatgcttcggtacagtccgtacttcacagtatcgacttccctattctctacggatataacgtagtgaaaaaaggaccatacggaatgtctatctttgccggtccaaaactccggtatctatggggaaagcagaacgaaatcactttcacaaacttcgaccagaaagggattcatgaaaagctgtatccgctcaaattcagggatttcagttcacgacctttcagatgcataaatcccctgtccagcggttctgccggatctatcagcccatcacccggttcttcacccggacctcccggattctcggtagacggagtatatactccgtctaccgagaatccgggaggtccgggtgaagaaccgggtgatgggctgatagatccggcagaaccgctggacaggggatttatgcatctgaaaggtcgtgaactgaaatccctgaattgtttcccggacttttacaggtacgtccaaagagaggggaaaaaactgtatgagcgtttgaatatcctgccggaatacttcgatatagacagcttcctgcacgtgtgttcggaatttatgccggggggattttatgagaacgtgtgcaagccgtccccactggagaacgatatgcagaaccgggattttatcgtctttgagctgacgaagataaagaaagatccgttcctgatttccgtcattatgacaatctgcgtgccacggatattccggataatggaaactgcactctccaccgattccagaaactcggccagcctgtcccggtctgccttcgccagtttctcgctatacgccaacgggttggcctggtacgctttttcaaggctttgcagtcccgaaagcgtaaaggacaatatgcagaagtgatgcaggtattcccgtccgtcgaaatacttcctttcggccgtctgtatatagccctccccctcgatcacatacggaggaagaagtaatgttaatccagccgaataacgtaacattcggccagtactctgtgaccgagtggcaagaaaacctcctgacgctcataagcgaccagatccagcaacacatgaccagggaaaacaactgcctaaagacctctttaaccagcctgtcgtcgagatcaaatgcgacgaagccggggggaagaacaacaagagcaaagttctgaaagaggctatcgccatgatgcggaaaaacttttcccgggttcaggattcccaatgtatcgggcaacatataacgtctgatgcttgtctgcttcaagccatccatcaactgaaacacatattcgggagaatctttcattccgttactccagtcttccagatatctggaagactggagtaacggaatgaaagattctcccgaatatgtgtttcagttgatggatggcttgaagcagacaagcatcagacgttatatgttgcccgatacattgggaatcctgaacccgtatccctttcttctgcccgatccttatcatatcggaacactgtatatcccttagtccctcgtcgtcatggaaaccgttcacgtaccggaaaaggtgctgtttcacctcggccacgttcaacggccggatctgcgtgccacggatattccggataatggaaactgcactctccaccgattccagaaactcggccagcctgtcccggtctgccttcgccagtttctcgctatacgccaacgggttggcctggtttgtcatatgcctcctgatagcgattggcgcggtagttcagaccggggatatcgatcatggcagcaaatccgttggctagaacacaagtcacttggtccatgccgcaggtaacggggcgggtagggtcttcacggtggcagatatcttgcaggaacttggctactttatatcctacagggctgcattgcgtggggacttcattaccgatactccacatcactacacagggattgttacgatagttgtgccggaggaagaagtaatgttaatccagccgaataacgtaacattcggccagtactctgtgaccgagtggcaagaaaacctcctgacgctcataagcgaccagatccagcaacacatgaccagggaaaaacaactgcctaaagacctctttaaccagcctgtcgtcgagatcaaatgcgacgaagccggggggaagaacaacaagagcaaagttctgaaagaggctatcgccatgatgcggaaaaacttttcctgtagatgttgatcatcccaggcaaatccgggatgagagtcgaacctgatagtatggagcgttcttcggaacaatccaatagtgcgtgtaagcatactcccaagaaaatccgctaaacttaatccttaaggtacccgtaccgcaaacggacacacgtagtcgggttgaatatactaaggcgcttgagtgattcacggttaaggaactaggcaaattgaccctgtaacttcgggataaagggtcccaacgagaccacgtttgtccgcttcttccgtaaggaaagaaaacatctcttcattcttcttgaacgtctcttcgtctacttccagcgcaaacggataatcttccagtttgaccaacgatgcaaacggatgaccatggtcatccgtttgcatcgttggtcaaactggaagattatccgtttgcgctggaagtagacgaagagacgttcaagaagaatgaagagatgttttctttccttacggaagaagcggacaaacgtggcctcctgatcggctatgtgtccggggtcgatgccactcactttcaggtcgatgggtttgctccacgggcccttgatgtcatttgcccagatcacccagtttgttcctttggccggataatagatgtacatctattatccggccaaaggaacaaactgggtgatctgggcaaatgacatcaagggcccgtggagcaaacccatcgacctgaaagtgagtggcatcgaccccggacacatagccgatcaggaggctgaaagctgccaatgaaggtcaatacaacttcctcagcgaagtgaaggtatatggtgacagagcgcagaagttaaaagagattttcctccgtcacggattctatctggtatatgacaatgacttggcgatccgattgccgacggattttacttcaccatcggctatccgggaatgacaagcggcgaacttgccaaagaactgatgtactatggagtgagcgccatttcactggtcaccaccggaagccacctactgttccgaactgggtagcatggtcttcaatctccgcctgactggtaaagagcccatcggctatgaatccccaagtcgcatttacattcgtaccgcgtgtctccatccaaggatagtctaccggccggtagactatccttggatggagacacgcggtacgaatgtaaatgcgacttggggattcatagccgatgggctctttaccagtcaggcggagattgaagaccatgctacccagttcggaacagtagctcactattatcccggaagcagacttgaaaaacaatatgaataacatctgagactaatgccatgatatcaacaagaaatgccaagaacataataccaagaaacaatcgaaatccgtggagctggatccagctccacggatttcgattgtttcttggtattatgttcttggcatttcttgttgatatcatggcattagtctcagatgttattcatattgtttttcaagtctgcttccgggataatagtgagcaaccccctcgccgaaagactaaggtttcctgatcaacgctaatcggatcagggttagtcgggtcctaaggctcagccgaacggtgaggccgatggcagaacaggttaatattcctgtactaccttaaagagtgacgtggagacggaggcgtgacagcgccgcggactgacggaatagtccgttgaagggtgtagatgctgatcatcccaggcaaatccgggatgagagtcgaacctgatagtatggaacgttcctgaaagctgccaatgaaggtcaatacaacttcctcagcgaagtgaaggtatatggtgacagagcgcagaagttaaaagagattttcctccgtcacggattctatctggtatatgacaatgacttgggcgatccgattgccgacggattttacttcaccatcggctatccgggaatgacaagcggcgaacttgccaaagaactgatgtactatggagtgagcgccatttcactggtcaccaccggaagccaccaaatatcattcaattcgaaatagcgattggcaatcacattacaaacatcttcagccacttttgcatccgtcagtccgagtttatctacaatcttttgcgaacggttgacgatagactccacatatttaaatatgtggagtctatcgtcaaccgttcgcaaaagattgtagataaactcggactgacggatgcaaaagtggctgaagatgtttgtaatgtgattgccaatcgctatttcgaattgaatgatatttatatactaaatgctccacgctatgatgacgacaggactctaagatgttataaaatccaataagattactttcaatataggcatcagggttagtgatgctatagcgtacaccggcttgtgcagcaaggttcacgactacctgaggatggtagttagtgaaaatagactcaacaatttcctttttagcaatactgtcttttatgaaaacaaatctgtcaccgtaagcagacaattcttgtaagcgttcatactttaagcaacagtcatgtcgaatacttttgcaatggaagttccgatggctccttcataagggatgtgtgctccctgaatgttgtctgcgacaattcgtccctgacgattggcgggaccagcaaggtaattgcaattaccttgctggtcccgccaatcgtcagggacgaattgtcgcagacaacattcagggagcacacatcccttatgaaggagccatcggaacttccattgcaaaagtattcgacatgactgttgctcctaagatgagcatgagtgttcttaaccctacgttaaaagtcagtggcaactttgatactccaatatggaacggagccatttttcatcaatcaaccttcaataacctttttaccaaaggactatcctaggatagtcctttggtaaaaaggttattgaaggttgattgatgaaaaatggctccgttccatattggagtatcaaagttgccactgacttttaacgtagggttaagaacactcatgctcatcttaggcttcacggaatttgtccagttggtagttcagaatttcgctgttactcattccgtgcgtatcatcaagcagagaatcaatatgaaggtctacttcaataatcccattttttccgctctgaccgtggttaaccacggtcagagcggaaaaaatgggattattgaagtagaccttcatattgattctctgcttgatgatacgcacggaatgagtaacagcgaaattctgaactaccaactggacaaattccgtgaagcttcggacatcgggcagaagactaaacagtgtatccaaagattcctccatcttccagacagaccactgcatatcaaccgttttatgttgcagaaataatcccatcgtttttggtttataatttcttcgaagaaattataaaccaaaaacgatgggattatttctgcaacataaaacggttgatatgcagtggtctgtctggaagatggaggaatctttggatacactgtttagtcttctgcccgatgtccgaagtagataaggctaccgggaagtttcatatcgtgatacacttcaccattatcttcgcccgcacgttttacaagtaacactttgagttgttctccgtcaaaaccaatcactacacagtctactgatatgtacatatcagtagactgtgtagtgattggttttgacggagaacaactcaaagtgttacttgtaaaacgtgcgggcgaagataatggtgaagtgtatcacgatatgaaacttcccggtagccttatctatcgatacctttttggttcaggaaggtgactgggtacgtcaaggagatactcttgttgtgatcaacagccccgaaatacatgccaagtatcagcaggtgaatgcattggagcaagtagccgtgcagcatgctgcacggctacttgctccaatgcattcacctgctgatacttggcatgtatttcggggctgttgatcacaacaagagtatctccttgacgtacccagtcaccttcctgaaccaaaaaggtatcgatcgctacggaacgtctgatcaccattgacggaagaaagatcaagatcatcgaagaagaaaaactcaagaaaataagcaagataggataatacagaccttatacgatcataaaaagtgatctgaaactagtttcagatcactttttatgatcgtataaggtctgtattatcctatcttgcttattttcttgagtttttcttcttcgatgatcttgatctttcttccgtcaatggtgatcagacgttccgtagcgatgatcctttacataatgcattggctgaaagaatgaacaacaccattaaaaacggttggctattcgactgtgatgatgagagcttcgagcaagtaagcaagcgcattgaagatgctgtatatgtatatggcctcatcaagggataaacatgaggacacctatggaagtggtcagcgaaacgggaggattaacagcataatacccgctcgtcgggacgggtggtcccgccccttgccgctagggcgatccccgaccgagcatgagagcaaaaacgcattcaaattacatgggggagatgtgtagaaccaataaaaagcaaattaaagcgaaagaaggctatttctggtaactttttgcataacatattggttaactttgcactagtgcaaagttaaccaatatgttatgcaaaaagttaccagaaatagccttctttcgctttaatttgctttttattggttctacacatctcccccatgtaatttgaatgcgtttttgctctcatgctcgcagacaaatgtagtcactgcaatacatgggatggcggaaacagtaggcagttccagcgtatttttgaatactgtcgcccataacccgagccagaatatatgcataaggtacataccatagctaagtacttagctatggtatgtaccttatgcatatattctggctcgggttatgggcgacagtattcaaaaatacgctggaactgcctactgtttccgccatcccatgtattgcagtgactacatttgtctgcgccggaaaggcgaagcctgctgccggaaaaaagaaagggacggggaaacggataggtaagtcaaaggtggagaaggctaataatcagttgaataggagagtgaaataagcctttggagactgcgcccgggcgcagtctccaaaggcttatttcactctcctattcaactgattattagccttctccacctttgacttacctatccgtttccccgtccctttcttttttccggcagcaggcttcgcctttccggccttatccagccttgaaattggaaaaatgcaattcaaattcaacgagtgtgatattgtagcgctatgcagaaatgtcatcgacatggtagagaaaataaagcagactcaagcggaagtacggttttccccctctctcagttcactgaagctgaccacggacagtgcccgcctgcaacaagtactgatcaatctgcttatcaacgccacaaagtttactgcacaaggcactatcaccctggaactggtgaaacaaacaaaatagaggtgatccgcaggctttccggtgtggaaatcgagcagacggccaccactccgcagataaacgcctatatcgaggcgaatatctatgataccgaacgttggccggagtaccggaagttatgccgacaggtggccggagaggtggaaaccgtggccgacatctttacgctccagtatattttagtggccgaactggaggatcagaccaggacgggaaaggactgccagccgcagccgacagatccgaaaaaaatagaggtgatccgcaggctttccggtgtggaaatcgagcagacggccaccactccgcagataaacgcctatatcgaggcgaatatctatgataccgaacgttggccggagtaccggaagttataccgacaggtggccggagaggtggaaaccgtggccgacatctttacgctccagtatattttagtggccgaactggaggatcagaccaggacgggaaaggactgccagccgcagccgacagatccgaaaggtacgatgagaatgaccggaaaatttgtgttgctgcttgcggctatgcttgccctgtttctggggcaggcgcaggcccaacgctgcctgccgggtatgaaaggtgtgcagctaatggcggatatggttgacggtttttattgcgggaaggaacgtaatgatacgggattcgctttcggacttgccgtttctacctatgctaagggaggaaataaatgggcatcgggtattgaaatcatgcggcggtattatccccaccataaacagcagctgcagaagcatctttcaatatactgatcgtttcaatatcgttaggattcacattctgaaggctctgctcaactccgtcgatcagcacataaggttctcctttattaatagaacccgtaccacgaatattgaacttgatttcagcacccatttcaccgccgacaccatcagcgactgcatctgttgaaaaattcaagcctgcgacattaccctgaagggcactggtcaagtccgttaccgaaacagtagaaacactagtagtgcctgtacactgcgaatcggagcagggaacggccttttttatcagcgatacacagttgctaacagctcgccatgtggtgaaagcccatttccaaagtgtggcggcacctgccgctatttatatcaatgtggctggacaatccctgctgtgtatgggagaagaactgtcaattccaggaaacgctattgatttagcattgctgaccgtagtaccagaagcagactatcatgcaaaaacagtagaaacactagtagtgcctgtacactgcgaatcggagcagggaacggccttttttatcagcgatacacagttgctaacagctcgccatgtggtgaaagcccatttccaaagtgtggcggcccctgccgctatttatatcaatgtggctggacaatccctgctgtgtatgggagaagaactgtcaattccaggaaacgctattgatttagcattgctgaccgtagtaccagaagcagactatcatgcaaaaacctcctcacgaaatgcgattggttttaacgtgttaagtaatgcggcggaaacgagggctacccctactaccaacaccaacttgaagaacaccgatttcgacgtgttcgcttttacggcggatgggactgccttcatgggaaagaacgacacggaatttgaacatgacggagtgaagatcgtgtacaaaaatggtaagtgggattatgacaatgcgagcgaccttcgttattggcctaccgaggctttggactaaacttatgtacgtccgcaggtatcggccgagatcgggaagatcacgaacccggagcttaaaaggatattgcaggacgagcagtttacggcggcaaaccagatcgtcgcagccatgagggaacaagggtacacgcaccaggtaaggaagggggtgcattccttttcacgggagggtgaagtgttccaggttgaacacaggctcttgaaagcgttcgaacaacctctgtctgacgagcagctaaaaagcataacggaaacttatgtacgtccgcaggtatcggccgagatcgggaagatcacgaacccggagcttaaaaggatattgcaggacgagcagtttacggcggcaaaccagatcgtcgcagccatgagggaacaaggctacacgcaccaggtaaggaagggggtgcattccttttcacgggagggtgaagtgttccaggttgaacacaggctcttgaaagcgttcgaacaacctctgtctgacgagcagctaaaaagcataacggaccgcaggggattacggggacatcgccccggtgtgggggatcgtccaaaaggacggggatatttaccgtttcgtcccctctgtcgcacccctgaaagagaaataccggatctccgaccgttacggctaccggacgcatccgataagcggtgaaaggcagtttcacgcaggcctggatatggcggcggtgtatgcggctaccgtacacgccgcagccagtgggacggtgacgttcgcaggtgaaacgcccggatataaattctggatgctcacaatagtgatatccggattattgccaagattgagaatcaggaaggggtggacaacatcgacgagattcttgaagtggcggacggcgtgatggtagcccgtggtgacctggggatcgaagtgccgcaggaacgtattccgggtatccagcgtgtgctgatccgcaaatgtatcctggcaaagaaaccggtgatcgttgcgactcagatgcttcataccatgatcaacaatcctcgtccgaaaattggttgtcgtatcgaacgcctatcagatcgaaaacctgatttccccggttatatcgctcatgctttccatttcgtcccggcgtttcacgctggcgaacaaagtgccgttcttctactttctggctgaagcgaccacgttccggatcgccgatttcgagaaactgccgtccgttctaagggaatacctttgcagtttcgttttcctcacgcagtcggcggcgaagatcgagaagatatacgggaaatatgacaaagaaaaatcccgtcacgttctccggaaattgcggcgtggttctcacgatctcccctttcgtcctgataagaaaccttagcttctgccccgaaacgccgtaaatcgtcagggtggaagtgaaagccgccttgtacggctcattgtccccggcgatcgtctggatgctgtctatctcgcatttatagaccgccccgttctgcaccgcatcaaaataggccttatcattataatactttgagaacacggcattcagaaagaagtgtcccaagacagcccttaccgccgggtgcggctcattcttcaagagatcgaaaaggacgggcatagcgtccctgaccgctttcgggttcaacgggatatgttgcgatccccgtatatagacctgcccggtacgataacccacaagatcctccctttgcaagatccccaccgtaacgaacggcatccacatctgcatataccagaccggatgatccgcccttaccgcttcccctgcgttctttcctttaaagaagtgtcccaagacagcccttaccgccgggtgcggctcattcttcaagagatcgaaaaggacgggcatagcgtccctgaccgctttcgggttcaacgggatatgttgcgatccccgtatatagccctgcccggtacgataacccacaagatcctccctttgcaagatccccaccgtaacgaacggcatccacatctgcatataccagaccggatgatccgcccttaccgcttcccctgcgttctttcctttaacaagatgcacgaagatccggaaacaaattccgatacatgtaccgatatgggatgccgtaccgcaagcgtttcaattcatttatcttgttctccccgtttccacttgcttccacctcggaaacaatgccttgcagaagctccaccgtttccgatttaccgggcattccgggatcattctccaccaaacgcagcaatcccctccagtcacgccccacgaataccgacgttttcagcgtgtcgggtagcggcgagtaacaagatgcacgaagatccggaaacaaattccgatacatgtaccgatatgggatgccgtaccgcaagcgtttcaattcatttatcttgttctccccgtttccacttgcttccacctcggaaacaataccttgcagaagctccaccgtttccgatttaccgggcattccgggatcattctccaccaaacgcagcaatcccctccagtcacgccccacgaataccgacgttttcagcgtgtcgggtagcggcgagtaacaagatgcacgaagatccggaaacaaattccgatacatgtaccgatatgggatgccgtaccgcaagcgtttcaattcatttatcttgttctccccgtttccacttgcttccacctcggaaacaatcccttgcagaagctccaccgtttccgatttaccgggcattccgggatcattctccaccaaacgcagcaatcccctccagtcacgccccacgaataccgacgttttcagcgtgtcgggtagcggcgagtggtcgttcacgagatcagcatcaaccccgattttatgaaccgggaagatcgggactggcattctaccctggtacatgaaatgtgccatttgtggcaggaggatttcggcaggccgagccggggaggggatcataattcgcaatgggctgacaagatgatccaggtcggactgatgccgtccgacaccggggaggccggaggcaaaaggacaggccagagcattacgcattatatcattccgggagggaagttcgaaaccgggtagccctgacgctcaacccctgggcgatccctttcctgctctactacggtacgggtgtcggcggtacaaggtacgggaagaacatcgccttaaccctccggggcaattacaccaagcggccctacaagatcatttgcagccaacgggacagacgggagtattattactcgatcgaccaattctgcaaagacctggagatcccggcctcctactcgaatgcacagatcgaccaaaaggttttaaggcctagcatctttgatgctttcgaacgtgcgcaggcttcttatccctcattgatgaaacgttgccgtgccttcgaccaacaactgatggctgatgcagaaaaagccggaggcaggaaatatgccgaactactcgcattgacttaccgccactccattaccgcccataaactccttaccgacaaggaaggcaacctgcttttcttatccaaagagaaccatagtaacggctgtatcaacacagtagacctaacttatccaaactatttcctgcccgatatgtcgagcatacggccggacactatctatctgaatgaggtgtcgcaaacgcacctgatcgcaccggaaaaggtgatttatatagattacggcgatacctgcatacaggaaagcaaggccgagaataccgagaatatcgtgcgaatgatcgcagccacgggaaaggtggaggaatttcccaggcagacaaacgtgtcgctggcgaccgaaggggggaagttctacacgttcaacgtgaactctcgttgggaccctttatcccgaagttacagggtcaatttgcctagttccttaaccgtgaatcactcaagcgccttagtatattcaacccgactacgtgtgtccgtttgcggtacgggtacctcaaggattaagtttagcggattttcttgggagtatgcttacacgcactattggattgttccgaagaacgctccatactatcaggttcgactctcatcccggatttgcctgggatgatcaacatctacaaacgacaagaagacaaaagaggcacgtgaaaaacaggaaaagatggaaaaactcctcaaacgtgcggaggaggcgttcacggcaggaagatactcggaagcgacaacctgcttcaggcaggccaaggtactcgcagatacggacaggcagaaacagatagaggcaaggatacaggaagtgcagaaggagtcgtcacagggctgcctgtttcctgaaacggacacacagccgcttccacaacagccgcccgcaaacaacgacaagaagacaaaagaggcacgtgaaaaacaggaaaagatggaaaaactcctcaaacgtgcggaggaggcgttcacggcaggaagatactcggaagcgacaacctgcttcaggcaggccaagggactcgcagatacggacaggcagaaacagatagaggcaaggatacaggaagtgcagaaggagtcgtcacagggctgcctgtttcctgaaacggacacacagccgcttccacaacagccgcccgcaaacaacgaggccggacgggagcttatcttagcccaccttatcaaaggccaaaaggagaaattcgattatatcctgatcgactgtcctccctcgctgtcgctgctcacgcttaacgcactgacggcctcggctcggttgattatcccggttcaggctcaattcctggcaatgcgtggaatggccaaacttatgcaggtagtccacaaggtgcagcaacgtttgaactcggatctttcgatcgccggggttctgataacctgggggaaataatggtccgtccaatctgtttaacgcaatgatttctcctttaatccctttgagtataaagggagtcatctggtatcagggagaatttaactccggcggctctggaaaagaatatgctaccctgttctcccggatgattacggattggagagagaaatggggaatcggtgattttcctttcgtatatgtgcagcttcccaatttcgaaccggtagatcccgagccgtctgtcgaaggaaacggctgtgacggaagtaagcacggcagcggaacttctgaatggagaaaacgtattctggtacgaagaaacccccaatctgaataagtttgcaaccaaaggaagtgaatttgagaaagtggttatcacaaagaatccgctgttgcacatcaaactgggcagcaccgacatcaccgccaatcgtatcgagctggacgtggaaggtttccgctttgagccggccgaccggaacttggtaagcaacggaaccctgtctgcaccgcaatacgcaactcttatacgtgcttccggccaacgagatcgtttacgaccagacggtagaggcgttccatatcaagaaccggagccacgtaaacctgatgaagtcgatccgtaacgacttttcagggggacggccgtattcggagatattcatccggtttatggatagttatgcaacggtggtacgcctggagctttcaccggaaaaattgcttgcattccagaccgacggcgagaaatggaacaaattgcaggagaatcccaatgccgacagacgttcgtaggttttcttctccctgttactctgcacacaaacaaccaaccaacactttttttcatccataataactcctccaattctatcatttaaagtcacaataaggtaccctccaagcgcgctccgctcccgccagtcacatacatgacggctacctgaaaaattttatgtcttatctatctaacttttttccttcttttctatcctgtaaaaaggaaaaagcctagtttatcaaaatcccaatgccgacagacgttcgtaggttttcttctccctgttactctgcacacaaacaaccaaccaacactttttttcatccataataactcctccaattctatcatttaaagtcacaataaggtcccctccaagcgcgctccgctcccgccagtcacatacatgacggctacctgaaaaattttatgtcttatctatctaacttttttccttcttttctatcctgtaaaaaggaaaaagcctagtttatcaaaatctaccggatttgtttccatggagaatatgcttgccgcctgttccaatgggcttcccgattccgccttgtgcgaatggtgctgccatagttcggtgccggtatgtgcggaacgttctgtggcaggtataccgtcccaccatttgaaaagttcattgtaaatgtttgcggaaaattccttgcccatgcgcgaaccgttaaatacttcccgcctgttatggtcgatgaacgtgacaccgtagatacgtccctgctaatctaccggatttgtttccatggagaatatgcttgccgcctgttccaatgggcttcccgattccgccttgtgcgaatggtgctgccatagttcggtgccggtatgtgcggaacgttctgtggcagggataccgtcccaccatttgaaaagttcattgtaaatgtttgcggaaaattccttgcccatgcgcgaaccgttaaatacttcccgcctgttatggtcgatgaacgtgacaccgtagatacgtccctgctctgaaaggaaacaaatcgcacgatgcgttcgtggccgaaatgttactctattttgaaacaacggggatcaccccgcagtcgaatgtaatgccgccgaacattgcggccaaagagcaggcaagccgggtgatcgaagttgtccggggcattgagaaatccactaacgtaaggctgaaaaacatcgaacaactccttttgtcgcttgtcggggaagtgaaaacgccgggggacaatccggacgaatatatgcacatcaattctccttgactttcgactggtttatagataaacgttatgatcagctagttaccagaaatgatattccggatatattaggtatcggcttgtctcctgaaaatgtagcagaaactaccaataaaggttttgatggacagattggttatcaagaccgttttggtaacttcaattttaataccaattttgtatttggttatgctaaaaatcgagtcgattataaagctgaggctcaacagaaatatgaatggttgaaattctccttgactttcgactggtttatagataaacgttatgatcagctagttaccagaaatgatattccggatatattaggtatcggcttgtctcctgaaaatgtagcagaaactaccaataaagggtttgatggacagattggttatcaagaccgttttggtaacttcaattttaataccaattttgtatttggttatgctaaaaatcgagtcgattataaagctgaggctcaacagaaatatgaatggttgaaatgagccgtacaaggtggctttcacttccaccctgacgatttacggcgtttcggggcagaagctaaggtttcttatcaggacgaaaggggagatcgtgagaaccacgccgcaatttccggagaacgagacgggatttttctttaaccagtttatacagcagattgtccggatagaacaagaacctgaaaaaaagtaacactatggataaggccacgaaaacaaaaataatcctgttcgcatccctggggatcttaatgagccgtacaaggtggctttcacttccaccctgacgatttacggcgtttcggggcagaagctaaggtttcttatcaggacgaaaggggagatcgtgagaaccacgccgcaatttccggagaacgcgacgggatttttctttaaccagtttatacagcagattgtccggatagaacaagaacctgaaaaaaagtaacactatggataaggccacgaaaacaaaaataatcctgttcgcatccctggggatctttcgctcaccgaaatgtttgaaatatccgactatgcggaatcatgccgtttcagcgattgtaaacatatcgacgagccgggttgtgctgttttagaggcggtacataatggtacgttagatcataagggatatgagagttatctgaaactcagacgagaagcatggcacttctccgcttccgaacatgaaaaacgtaaaaaggagaaatcctttacgaaactcgtagaagaagtgaagaaacgcaaggctaatttcaatgggaacgtgacggaaaagaatacggctggggaaacaaccgcggactcgtactgatgaaatcgtgggacctgatcaactggaaacgtaccaatgcccgtttcgacctgttatcggcaggcttgggtgaaatcggctgcgtatgggcgcccgaagtgacttacgatgacaagaaaggtaaactgatgatttacttcaccatgcgtttcaagaacgaggcgaacaaactgtactatgtctatgtcaatgatgactaatgggaacgtgacggaaaagaatacggctggggaaacaaccgcggactcgtactgatgaaatcgtgggacctgatcaactggaaacgtaccaatgcccgtttcgacctgttatcggcaggcttgggggaaatcggctgcgtatgggcgcccgaagtgacttacgatgacaagaaaggtaaactgatgatttacttcaccatgcgtttcaagaacgaggcgaacaaactgtactatgtctatgtcaatgatgactaagcatgagcgatataaccggggaaatcaggttttcgatctgataggcgttcgatacgacaaccaatttcggacattccggatctatcaggttaaagtcgaaatcatttccggaaaggacataacactcctttttttcgttggcgagcgtgcttagactgttggtaaggctgcttagatagctgctttgcgtcttggggctgtcctttgcgtccaggaatgccccggccagtacccggctctggtgcttgccctcaagcatgagcgatataaccggggaaatcaggttttcgatctgataggcgttcgatacgacaaccaatttcggacattccggatctatcaggttaaagtcgaaatcatttccggaaaggacataacacgcctttttttcgttggcgagcgtgcttagactgttggtaaggctgcttagatagctgctttgcgtcttggggctgtcctttgcgtccaggaatgccccggccagtacccggctctggtgcttgccctcacaaaagacaactaacataggaataagaataacaaaagtaaacctatttagatattaaagtatattgagtaaactaattcagttataacaaacgaagttgtcaactaaaaccagtacacatcagtctatacagagctttttagtttctcccgcttgaaacttttgtttctcctgcttggaactaaagtttcatcggcttgaaactttagtttcaaagccgtgaaaccaaagttccggacgcttgaaaacagtggtacaatggtaaaccgctggttacggtttggggagtcggatttaatgataatcgtcgctatgggctgaaagaagccgctcatattattgacggcttgaagtcacagggattcagtgtgatgcttggagtacctacgcagtggcgtacactgaatggggacacagaatcagatccccgcctgcatgagcttatccgaaaatgtgatatcatgatgccttggtttgtagggcgttataatgaaacgacttatcccaagtacaatggtaaaccgctggttacggtttggggagtcggatttaatgataatcgtcgctatgggctgaaagaagccgctcatattattgacggcttgaagtcacagggattcagtgtgatgcttggagtccctacgcagtggcgtacactgaatggggacacagaatcagatccccgcctgcatgagcttatccgaaaatgtgatatcatgatgccttggtttgtagggcgttataatgaaacgacttatcccaagtacaaggcgttcggtctgctcttcgttgctccatgcgggttctcccatatccgtccagaagccggagatgccatcgtcaatgggtttctgctgataggttccccaccagtcggctacggcaggtaaggtaaaatccactaccccacaatttccgccccaaggccacggcatgtcataactcttcccgttcgtgctgtccttgacaaaatatcccagacggtccgcttcctcccattgcttcttgttggcttgcgagacaaggcgttcggtctgctcttcgttgctccatgcgggttctcccatatccgtccagaagccggagatgccatcgtcaatgggtttctgctgataggttccccaccagtcggctacggcaggtaagggaaaatccactaccccacaatttccgccccaaggccacggcatgtcataactcttcccgttcgtgctgtccttgacaaaatatcccagacggtccgcttcctcccattgcttcttgttggcttgcgaggaaagccgacacgattatcctgttcatccatgcgagaaatccccaagaactgcgaggcgaccagcaacaacaatactcgttcgtttaccgttgggtttacggtgctttaagctatccgagcgacaacaccccggtaagggcactcgacaagatcctggaaagcggacggctgaaagacgtgtacgaccgttgtgcatattacgacgataaggtttgcagcggtgaaatgagtacagcccacgcacaaaattcactcaacttcttcgtcttaattctcacactactcagccggaacttgacagaacgaatctgatcgctttgcaagctactctgaaaggtgatgcaattgatcaagatgagaaaaatgccgtcattacttctctgtatgtagctgtatatgataatattttggctgctgaagatgttcgtatcgctgataaggaaactttgtttgaaggtggtaatgctgctcattatgcaactacattcgatgcttgtacgaaagaagaatcaagatgacattgacggtagacgaaaacggcaaaccgttttataatgtgtcggtggatgactccctcttgatagaaaattcagccatgggctttacggcggctaacggcatcattctggcagaaggttttcaggtgaagaacacgactttcagcagtgaagacgaaacttggacacagccgtggggagagaataaaaagaaccggaatcattataacgaaatggcagtcagcctgacaaatgaagatcaggtacacagattattgatgttgtttccaatgcgatagacggaaaccgtatcgacgaggattttataaagagttgtatttacggcaaagtgaatgcggaactgtatgcgcatcttttaggcaaatacagggggtatgacggggatttctttcagttttatttggggacggacgatcggataaaccgggctttgctggagaacctggggattaaggtcgaacccgacaaatatccggactatgatagccggattgttgcgcaacagattattgatgttgtttccaatgcgatagacggaaaccgtatcgacgaggattttataaagagttgtatttacggcaaagtgaatgcggaactgtatgcgcatcttttaggcaaatacagggggcatgacggggatttctttcagttttatttggggacggacgatcggataaaccgggctttgctggagaacctggggattaaggtcgaacccgacaaatatccggactatgatagccggattgttgcgcaacagtactggttcgctatcggtctctcgggagtatttagccttaccggatggtcccggcagattcacgcaagatttctcgtgtcccgcgctactcaggataccactacgcttaatttgacttcgtatcccggactatcaccgtctatggttcaactttccagaggattctactcatcaaatgtcttgcgacatcgtggtcctacaaccccacacatgccgtaacatgggtggtttgggctattccccgttcgctcaccaaggggagttagaagaagaaaagaaaacagttgaggtttctgaagccattacagagactccgactgaagaaggtaccgaaaaagttactgaagaagttactgccgaagttcagactgaagcagcacctaaacctgccacaaaggaagacgtactgaaccgattgaaagagcttgcgcaagactcggaaaacgcaaacaagcaggaaattgacaatctaaaacaatcattctacaagttacacaacgccgagtaccaaggggagttagaagaagaaaagaaaacagttgaggtttctgaagccattacagagactccgactgaagaaggtaccgaaaaagttactgaagaagttactgccgaagttcagactgaagcagcccctaaacctgccacaaaggaagacgtactgaaccgattgaaagagcttgcgcaagactcggaaaacgcaaacaagcaggaaattgacaatctaaaacaatcattctacaagttacacaacgccgagtaccatctgatcgaactgggcgtgacacacgtgcatctgcttccttcttttgattacgcttcggtagatgaaaccagactgaatgaaaattcgtacaactggggatatgatccgcaaaactataatgtacccgatggttcctatgccactgatccctatcagcccgccactcgtgtgaaagaattcaagcagatggtacaggcactgcacaaagctggtatccgtgtgataatggatgtggtgtacaatcatacataccatctgatcgaactgggcgtgacacacgtgcatctgcttccttcttttgattacgcttcggtagatgaaaccagactgaatgaaaattcgtacaactggggatatgatccgcaaaactataatgtccccgatggttcctatgccactgatccctatcagcccgccactcgtgtgaaagaattcaagcagatggtacaggcactgcacaaagctggtatccgtgtgataatggatgtggtgtacaatcatacattcgacctgcgggtgcatggtacagaactggatgccttcatgcgtgcccacgggcttaccgcgcaggaacagagcgagatgctccgttcagtgacgggtgaggacatctctccgacttatgtggcggggggaaaggtgcaacaacatgtgcgctatctgccggaaatgaaaagacaaatacagacagaaacggacaggctgttcgtaagcccgcgtacaaggcctgtgagtgtgataaggaaagagtttccggactacctgggcgaaagaacttaaacaggcatacgaacagtttcaagtgctgggggaatccagggacatactgactaagagcctggatctgtaccggcaggtgaacggggttatcaaaaactctaaaatggggttgcaggtgctttccatgcagggggaaatgttggaactggcggcgaaagagtgcacccggtcggacgtgtttaccggacaggaggcatacggggaatatacgaacgtgctgaacaagatcatggagaccgatcccggtagcggcggacgtcatatgtcgaatcacttcgccaaaccggaatggcatattgaaaatatatcttctgctaccggaacgcatgacctgcatgcggcgggtgtagcaagagcaatggtatattatgggcataaaggagtagcaatcacttcgcacggagaatctgctacttccgaaggctttgtttacgaggctatcaatggagctagtctggaacgtcttccagtgattttcgttatacaggataccgatcccggtagcggcggacgtcatatgtcgaatcacttcgccaaaccggaatggcatattgaaaatatatcttctgctaccggaacgcatgacctgcatgcggcgggtgtagcaagagcaatgggatattatgggcataaaggagtagcaatcacttcgcacggagaatctgctacttccgaaggctttgtttacgaggctatcaatggagctagtctggaacgtcttccagtgattttcgttatacaggataccgcaggggattacggggacatcgccccggtgtgggggatcgtccaaaaggacggggatatttaccgtttcgtcccctctgtcgcacccctgaaagagaaataccggatctccgaccgttacggctcccggacgcatccgataagcggtgaaaggcagtttcacgcaggcctggatatggcggcggtgtatgcggctaccgtacacgccgcagccagtgggacggtgacgttcgcaggtgaaacgcccggatatctcctgcaatttgttccatttctcgccgtcggtctggaatgcaagcaatttttccggtgaaagctccaggcgtaccaccgttgcataactatccataaaccggatgaatatctccgaatacggccgtacccctgaaaagtcgttacggatcgacttcatcaggtttacgtggctccggttcttgatatggaacgcctctaccgtctggtcgtaaacgatctcgttggccggaagcacgtataagagttgcgtattaccggcaccttctcggtggagggcgaccgcatcaccctgctggaggccatcgccaaggcgggcgatgtcacccaaaggggccgggtgaaccgtgtggcggtcatccgtgaggaggacgggcagcgggtgatgtaccagcacgacctgcgcagcaaggagctgttcgagtcgccctgcttctacctgcaacagaacgacatcgtctatgtcgaaccgaaataccgcaagcaggaccgcgaggacaagggctggaagaccggcaccttctcggtggagggcgaccgcatcaccctgctggaggccatcgccaaggcgggcgatgtcacccaaaggggccgggtgaaccgtgtggcggtcatccgtgaggaggacgggcagcgggggatgtaccagcacgacctgcgcagcaaggagctgttcgagtcgccctgcttctacctgcaacagaacgacatcgtctatgtcgaaccgaaataccgcaagcaggaccgcgaggacaagggctggaagcactacggtaaatgcgtgtggaaatgctaaatcagacgaactccaacttcccgttccatcggctgccgcaggcaatgtgaaggcgccggcaaatttgaaattatgaatcttgatcacgtcgatgtccacctgcatgttatcgtattgggtctttgctttgaatacgacctgtgacagaatatgtttgaaattaaatttcactattccgttgttcatgtcttttgtctggcctttggccatggcatacatcacgtcactcttattgccagcgccgtaaggtaggagcgttgatcgtcaaagacaaaatgattatctccgacggatacaatggtactccttcgggcttcgaaaacgtatgcgaggacgagaataacctgacaaaaccttatgttctccatgcggaagcaaacgctatcaccaagatagcacgctcgaacaacagcagcgacggtgccacgatgtacgtcaccgcctcaccttgtatcgaatgtgcaaagttaatcatacaggactcttattgccagcgccgtaaggtaggagcgttgatcgtcaaagacaaaatgattatctccgacggatacaatggtactccttcgggcttcgaaaacgtatgcgaggacgagaataacctgacaaacccttatgttctccatgcggaagcaaacgctatcaccaagatagcacgctcgaacaacagcagcgacggtgccacgatgtacgtcaccgcctcaccttgtatcgaatgtgcaaagttaatcatacaggactttgccacggtgcgggtagtattcgactggaccaagatttccaatcatgacaagcctgaaggcatgagggtcgtattttatccgaccgatgatgaaagcaacacgtggatatttgatttccccggcggagaggatggggaagtggagctccccgagaatgattaccgggtaatttgcttcaactacgataccgacgggatggtttggaaagaaaacggcagttacacgctttttactgccgatacgcgtgatgactgatactcatcaatgataaagtcttttcttataatgggcacatcgaccaaaggacgtgctgtacgaatatctttcagacttcctccaaaaaacttctcatcagtgagaatagagagggcggaagcacctgccgcaaggtatgacggaacaatttcttcgggacgtgcctcctgtttgatccaccctttggatggcgagcgacgcttaaattcggctataataccggaatcggaagaagccaatgcccgtttcaactgatactcatcaatgataaagtcttttcttataatgggcacatcgaccaaaggacgtgctgtacgaatatctttcagacttcctccaaaaaacttctcatcagtgagaatagagagggcggaagcccctgccgcaaggtatgacggaacaatttcttcgggacgtgcctcctgtttgatccaccctttggatggcgagcgacgcttaaattcggctataataccggaatcggaagaagccaatgcccgtttcagagggcaagcaccagagccgggtactggccggggcattcctggacgcaaaggacagccccaagacgcaaagcagctatctaagcagccttaccaacagtctaagcacgctcgccaacgaaaaaaaggtgtgttatgtcctttccggaaatgatttcgactttaacctgatagatccggaatgtccgaaattggttgtcgtatcgaacgcctatcagatcgaaaacctgatttccccggttatatcgctcatgcttactgggtggtgaccatatgctgtgcaaagaatatttcccgaacgacaacctgacgatgagcgaggaactgaaaacggcaatggttcactactacgacttcctcacgtcttatcagaacctgctccgcgatggcggaacggagaacagcatcgctatgaactgtaccaacggagaaatgaaactcaacgtatggcctccaaagttggggtcggtcactacttacgccaagcaggtagacggcaagcaagtagtgcaactgggtggtgaccatatgctgtgcaaagaatatttcccgaacgacaacctgacgatgagcgaggaactgaaaacggcaatggttcactactacgacttcctcacgtcttatcagaacctgctccgcaatggcggaacggagaacagcatcgctatgaactgtaccaacggagaaatgaaactcaacgtatggcctccaaagttggggtcggtcactacttacgccaagcaggtagacggcaagcaagtagtgcatcgctcaccgaaatgtttgaaatatccgactatgcggaatcatgccgtttcagcgattgtaaacatatcgacgagccgggttgtgctgttttagaggcggtacataatggtacgttagatcataaggtatatgagagttatctgaaactcagacgagaagcatggcacttctccgcttccgaacatgaaaaacgtaaaaaggagaaatcctttacgaaactcgtagaagaagtgaagaaacgcaaggctaatttcccgataagcggtgaaaggcagtttcacgcaggcctggatatggcggcggtgtatgcggctaccgtacacgccgcagccagtgggacggtgacgttcgcaggtgaaacgcccggatatgggaaaacgggagtcgttacgcaccgtttcggatttcagaccagatacgcacatctgacactcatttacacccggaaaggtgcgaaggtggaaaagggggacgtgatcgggttcgtgggaagcaccgggataagtaccatatactaaatgctccacgctatgatgacgacaggactctaagatgttataaaatccaataagattactttcaatataggcatcagggttagtgatgctatagcgtacaccggcttgtgcagcaagggtcacgactacctgaggatggtagttagtgaaaatagactcaacaatttcctttttagcaatactgtcttttatgaaaacaaatctgtcaccgtaagcagacaattcttgtaagcgttcatactttaaatatcgaggacgtgcaaaggcggcataactgggtagggcagcagattcaggaggttatcatgctgccgttcaatattgcggcttatacgatactcctgtacgcaacgaaatatatatttttcttcttggcgtcagcccggtatctgtatcttatactcctggagatcgtcacgccgatagccgtaatactctacatggacgagaaaacgaggcattatacgcacgcatacctgaaaaacctgtttgtctgttacaatatgcgtgtatatccaaaacttgaacctggaaacattacggccggacaagacggtaaaccccttgtcctctctgattactaccctattgggggaactggccgcaatcgaacgccaggggatcattggccgccttaatagcggacgggagttgtacatccagaaagggggcaggctgggacggaagccgggaagccggaaaacggccgaacagaggaaagaggaataccgggaggcgatcgccttgttgaagaaaatcagtaaatccgatgacgcgtgcgccgaggcgattggctgctgtttcgaaactcaaacgggtacgggtggaaggttcgaagaacagggttgctactaccttaccttgcaataaccggcggttggggttcatttcaaactgcttcgccatttcgagcatgtagaggattttttctttagaatgttcggcaatggttactaaacttctgttttccattttgttatcttttatgtggatagaacttgttttaccggaatcagtaaatccgatgacgcgtgcgccgaggcgattggctgctgtttcgaaactcaaacgggtacgggtggaaggttcgaagaacagggttgctactaccttaccttgcaataaccggcggttgggggtcatttcaaactgcttcgccatttcgagcatgtagaggattttttctttagaatgttcggcaatggttactaaacttctgttttccattttgttatcttttatgtggatagaacttgttttaccggaatccaggcaggagggaacgacgctaaggccgtccttatgctcgtagatcggcaggtcgtattcgcctttcatcgcaccgtagatcgtttggggaagctccgcagagaagcccagcgattcggtcagggtggcctgcccgtcaaggtcgatcaaaagaaccttgtaccctttttgacgtaacgcaccgcccaggttgatcgtggttgtggtctttcctactccccccttgtgattcaatacggagattacttttgcatcctgttgtatagccaggcggccacggtgcgggcattgatgccgctgggcatcgcgttaggtatttctccgtatatgctgattgccttattccccgcagtgaacggatatttctttatcccgaattacccgactgtcgtagccgccattaatttcgaccgcaccgggacaacaaaaatcggtaaatatgtgttgaatcattcgtttatgatgcccggactggtatctaccgtagtcgctattgttttaggactgatcctgttgtatagccaggcggccacggtgcgggcattgatgccgctgggcatcgcgttaggtatttctccgtatatgctgattgccttattccccgcagtgaacggatatttctttatcccgaattccccgactgtcgtagccgccattaatttcgaccgcaccgggacaacaaaaatcggtaaatatgtgttgaatcattcgtttatgatgcccggactggtatctaccgtagtcgctattgttttaggactgatctccaggtctttgcagaattggtcgatcgagtaataatactcccgtctgtcccgttggctgcaaatgatcttgtagagccgcttggtgtaattgccccggagggttaaggcgatgttcttcccgtgccttgtaccgccgacacccgtaccgtagtagagcaggaaagggatcgcccaggggttgagcgtcagggctacccggtttgtgcctttgatgttgtgtaccgtcgttatcaccaccccgaacgtttccagttcagaatatcttttcgttggatgaatattacatccgaagcggccatgtagtaaggcaggtcgcagttgtctataggttcgtcgctggctccggcgtgcattctgcgcaggcggttgagcaaggggataagcaggtaatatcctgcccgggatgtccagcgcttgaagaagttgctgccatacctgttgaatctcgaaaacgggtacagccgtggagcaagcaggaacttctttgcttcatcccattttcggaatcgtcgcatcgacgggtgggggaaagtcggttacgtcgttgaacatcatccagcagaacatcgagcagaattataaacagatcgtcgtcgagttcggaaagagcttttaccagctttcgcagttgtgcccggacaggtcgctgcatattgattatgacggcagcagcccgttggggatcaatccgttctatacggccgggaagcagccggacaacgagaagataaagacgcttgtaaacctggtgcttaaattcattacgacttgtcccggcatcgaaaggctggtctttttatcacctttcaaaagctcgaaatcgaaaagacggaaaaagcccggatcggcataagctatctggttttcccgcagtgtcaactcaccatacttcacaatctgttcaggttggagcagagagccgattcgggtataatcttcaattcccgcaagattctctttcattgccgagccgtatccgaaagagctgcttgcccagttatcggtcagcacctccattacgacttgtcccggcatcgaaaggctggtctttttatcacctttcaaaagctcgaaatcgaaaagacggaaaaagcccggatcggcataagctatctggttttcccgcagtgtcaactcaccatccttcacaatctgttcaggttggagcagagagccgattcgggtataatcttcaattcccgcaagattctctttcattgccgagccgtatccgaaagagctgcttgcccagttatcggtcagcacctccattatatagaaagaaatgtaaggccggcgaagcaaacagttctactccctgtgatgctagttctttggcacgaagcaacgtgctgataagcattcgttcataggctaccgatgtcttgtgcaaatatacctgccaatacatgaggcgacgtgctgtcaggaaattttcgatagagtagatacctttggattcaattacgagacggtcgtcggccacatcaagcatcttgatgatgcgggcagaaccgatattcccattatatagaaagaaatgtaaggccggcgaagcaaacagttctactccctgtgatgctagttctttggcacgaagcaacgtgctgataagcattcgttcataggctaccgatgtcttgtgcaaatatccctgccaatacatgaggcgacgtgctgtcaggaaattttcgatagagtagatacctttggattcaattacgagacggtcgtcggccacatcaagcatcttgatgatgcgggcagaaccgatattcccgccctcactcctgtgatagaactaatgcgcattcggagtttatcaagacttgataggcggtgaagccctcgcatcttatcagtcgctctacctcacattagtaactcacaaggctgcacctaaatgcatttcggggagtacgagctatctccaagtttgattagcctttcacccccaccctcagttcatccggaagcttttcaacgcttatcggttcggtcctccagttagtgttacctaaccttcaacctgaccattcggctgttatgccgaatttgatactaccgatcatccggaagttatggtacgttccggaatatcttatgtagatatggcaggggcttccaacaatctttccaatgagataacggaaccattcgggtggaattttgaagctgtacacaaacatcagtcggatagttggaataatattttaaacagggttcggatatacagcaacgattatcgggaaaaagtaagattctacaccaatttataccgtgcgttctgattcggctgttatgccgaatttgatactaccgatcatccggaagttatggtacgttccggaatatcttatgtagatatggcaggggcttccaacaatctttccaatgagataacggaaccattcggggggaattttgaagctgtacacaaacatcagtcggatagttggaataatattttaaacagggttcggatatacagcaacgattatcgggaaaaagtaagattctacaccaatttataccgtgcgttctgatttcaaacctgtattcggcaaaaagagccactttcgggcttagcaacatttccggccttatcccgacctcgtacccatacacgaaagccttgcttttctccaggtacacaagatcgcttttcgcctcggctttctggtagccgatcgtcccggctgcgatccccaggagcgagaatttccgtcctttcagggcgtaataggccagctccgggccgaccgtcacggtgtttgcctttaccagatcccggtttagaccttgtcctcgtacatttcaaacctcaaatgaaagttcctcatgttggaatgtgccgcactccccacgaactcgcccgatttcaggctggtaaagaaattcgtgtcgtatatttcctctttctgcgtggaaactgtacggctgcggttctcccctccccggctgcttccggtggtctttgaaaccctctgcctctcctcttttccaaaaacaagcgggtagcttttcaaggcctctatgtcctttgtccggccaactgatcagctgtgggttagtgatatcacttacattaccatatggttgcctgacggcagttatgtgttctgctacctgtctctggtgacagacgcctatacgaaggagatcattgggtattgcgtaggtgatactctgggaagctgttacacagtggaagctctggaaatggcagtcagacgcatagctgcaaaggagattaagggtttgatccatcactccgaccgaggcgtacaatatgccagtgcggattataattgtacagtcactctgcagtcgtcacaaaactataattgtgtcggtacactcattatcaagcagcagccgagaggatatattgttgacattgacgaatcaaagaaggaatatcaggtgaaagctactggagaaacaatcacgattccatttaaagtaaatggtcctgcagatgcgtatacttatgaagtggaggcttctgcccgtgaatggattacgcctttgcctgccacgagaggtatgcgcgatgcttccgattgtacagtcactctgcagtcgtcacaaaactataattgtgtcggtacactcattatcaagcagcagccgagaggatatattgttgacattgacgaatcaaagaaggaatatcaggtgaaagctaccggagaaacaatcacgattccatttaaagtaaatggtcctgcagatgcgtatacttatgaagtggaggcttctgcccgtgaatggattacgcctttgcctgccacgagaggtatgcgcgatgcttccgatgaaacaggctattcacggcgatgcaagtgctttgagccagatacctgatgcgctgactctgtttatcggacagaacggcggatgtatcggtgaagtaagtgcgctggcactgttgctcggactggtatacatgctctggaaaaagatcatcacctggcatattccggtttctatcattgtgactgtatttgtatttgcaggcattatgcacatggtggatcccgaaaagtatgtttctccgatattgcaactaatgaaacaggctattcacggcgatgcaagtgctttgagccagatacctgatgcgctgactctgtttatcggacagaacggcggatgtatcggtgaagtaagtgcgctggcactgttgctcggactgggatacatgctctggaaaaagatcatcacctggcatattccggtttctatcattgtgactgtatttgtatttgcaggcattatgcacatggtggatcccgaaaagtatgtttctccgatattgcaactaatgcccgtgtcagcccgaagaaacttttcgaggacatggacaagttcatagaagccaccaaagattttcaattagttctttaatcctttaatacagaaaactatatgcgaagcacattttcacttttaccctacattaaccgcagcaaagtaaaggctgacggtacgaccgccatactctgccgcataaccattgacggcaaacagactgccatcagtacggggatttattgccgaccggaagaatggaacagcaatgcccgtgtcagcccgaagaaacttttcgaggacatggacaagttcatagaagccaccaaagattttcaattagttctttaatcctttaatacagaaaactatatgcgaagcacattttcacttttcccctacattaaccgcagcaaagtaaaggctgacggtacgaccgccatactctgccgcataaccattgacggcaaacagactgccatcagtacggggatttattgccgaccggaagaatggaacagcaatgctcaccgagggcgatatgatcgtccggatcaggtcaaaggaaagcacgctttcctccatgatcttgttcagcacgttcgtatattccccgtatgcctcctgtccggtaaacacgtccgaccgggcgcactctttcgccgccagttccaacatttccccctgcatggaaagcacctgcaacaccattttagagtttttgataaccccgttcacctgccggtacagatccaggctcttagtcagtatgtccctgatgctgcacaactatcgtaacaatccctgtgtagtgatgtggagtatcggtaatgaagtccccacgcaatgcagccctgtaggatataaagtagccaagttcctgcaagatatctgccaccgtgaagcccctacccgccccgttacctgcggcatggaccaagtgacttgtgttctagccaacggatttgctgccatgatcgatatccccggtctgaactaccgcgccaatcgctatcaggaggcatatgacaaaatgcgctacaaacgctaaagcaactgatgccccgcaacgtaatggcaggcgtagcaacgtccgaccattcacaatggagtctcccatctgtcgagattgaagatgctccccgtttcgaatggagaggttttatgctggacgaaggcagacatttcttcggtaaagatgagataaaacgagtgatcgacatgatggccatctacaaaatgaatcgtttccactggcatctgacagaagatcaaggctggagaatcgatgcgctacaaacgctaaagcaactgatgccccgcaacgtaatggcaggcgtagcaacgtccgaccattcacaatggagtctcccatctgtcgagattgaagatgctccccgtttcgaatggagagggtttatgctggacgaaggcagacatttcttcggtaaagatgagataaaacgagtgatcgacatgatggccatctacaaaatgaatcgtttccactggcatctgacagaagatcaaggctggagaatcgatggaagctaacgcagggaactgaaacatcttagtacctgtaggaaaagaaaataataatgattcccctagtagtggcgagcgaacggggaatagcccaaaccacccatgttacggcatgtgtgggggtgtaggaccacgatgtcgcaagacatttgatgagtagaatcctctggaaagttgaaccatagacggtgatagtccggtatacgaagtcaaattaagcgtagtggtatcctgagtagcgcgggacacgagacatcatggcggatctcagtactttgttctgtggcttccatccgaagcgtgtgttcaacggctatctttttggtggagtaggactgaaccgtggttttgacaatgacgaagcaaatgcgctcgatacccgtacttatgagatggaatatctctggcaggaaggtaagttcctcgttgccggacgtttcggccttggttgcgactttcgcctaaacgaccgcctgtctatcaatatcgaagcgaatgccaacgcagacatcatggcggatctcagtactttgttctgtggcttccatccgaagcgtgtgttcaacggctatctttttggtggagtaggactgaaccgtggttttgacaatgacgaagcaaatgcgctcgatccccgtacttatgagatggaatatctctggcaggaaggtaagttcctcgttgccggacgtttcggccttggttgcgactttcgcctaaacgaccgcctgtctatcaatatcgaagcgaatgccaacgcagatccgagttcaaacgttgctgcaccttgtggactacctgcataagtttggccattccacgcattgccaggaattgagcctgaaccgggataatcaaccgatccgaggccgtcagtgcgttaagcgcgagcagcgacagcgagggaggacagtcgatcaggatataatcgaatttctccttttggcctttgataaggtgggctaagataagctcccgtccggcctcgttgattaactccgtttcaacggccgagagcaccagacgtttctgggcatatactgaagagaaacatatccccgatgctgccatcaatacaaaaagaacggatgatttcttcataattcaacatgtttttcatttggtttgtgattcccgctttttccccgatagataaaccagtaaagcagcggtatgataaagaggctgaccgccgtaccgatggacatcgtgcctatcatggcgatagacaacggcttttgcagttccgatcccatatccgaggagaacaagcaccagacgtttctgggcatatactgaagagaaacatatccccgatgctgccatcaatacaaaaagaacggatgatttcttcataattcaacatgtttttcatttggtttgtgattcccgcttttcccccgatagataaaccagtaaagcagcggtatgataaagaggctgaccgccgtaccgatggacatcgtgcctatcatggcgatagacaacggcttttgcagttccgatcccatatccgaggagaacaagcatctttgatgctttcgaacgtgcgcaggcttcttatccctcattgatgaaacgttgccgtgccttcgaccaacaactgatggctgatgcagaaaaagccggaggcaggaaatatgccgaactacccgcattgacttaccgccactccattaccgcccataaactccttaccgacaaggaaggcaacctgcttttcttatccaaagagaaccatagtaacggctgtatcaacacagtagacctaacttatccaagctctgcatatcgacgaactgcgagcgaagcggcactacgatataatcggctaaaggagaatagaaagccctgtcgccttgctgctcccgtatcgggcaaaaccagcttttcgcctccagcatggcctctatttcggggtgcgcctctccggttgtcccgtcgggctgctctgcctgtccccctctgaacttctcccttaacgcttcccattcttccggcctcacgtccgaaaaattggtctgatccaggttaaagtaccgcttccatactcatccatgcaggtataacttatcttttggacatccttggtggcttcccaactataaaacgccatcatgtcttcactaaccgttccgggattgaacgcgtaaaagtccaaaccctcggtaggccaataacgaaggtcgctcgcattgtcataatcccacttaccatttttgtacacgatcttcactccgtcatgttcaaattccgtgtcgttctttcccatgaaggcagtaccatccgcagtccgatggattcgaggcaggaagcataaagcagtgccatatccagacaagttccgagcttttgtgccagtacggaatctgtcagacggacacgctgcccgtgctcttcgaagctggcgggaatggtgctgtaaataatttgctgttcggtaagagcggtgtagatggctgccatctgctttctcacacggtccggattgcggctttggtattcgtccagtgacggagtaccggtccactgttccagaatggcgagtccgatggattcgaggcaggaagcataaagcagtgccatatccagacaagttccgagcttttgtgccagtacggaatctgtcagacggacacgctgcccgtgctcttcgaagctggcgggaatggggctgtaaataatttgctgttcggtaagagcggtgtagatggctgccatctgctttctcacacggtccggattgcggctttggtattcgtccagtgacggagtaccggtccactgttccagaatggcgagtccggaaactctttccttatcacactcacaggccttgtacgcgggcttacgaacagcctgtccgtttctgtctgtatttgtcttttcatttccggcagatagcgcacatgttgttgcacctttccacccgccacataagtcggagagatgtcctcacccgtcactgaacggagcatctcgctctgttcctgcgcggtaagcccgtgggcacgcatgaaggcatccagttctgtaccatgcacccgcaggtcgaagttattgatggatgttcacggaacaggttgctatacttcgcaggcagccatgaagctgtacaaccggcaaaacgaacagttgggcgatgcagcagaaagagcggcggtcgctgccgaatggttgggtactgccagctatccgcaacacacgctgacggaggcatggaaacgtttcatcttccatcaattccatgatgacctgacgggaacgagtatcccccgtgcctatgagttctcatggaacgatgaactgaagttcagaatatcttttcgttggatgaatattacatccgaagcggccatgtagtaaggcaggtcgcagttgtctataggttcgtcgctggctccggcgtgcattctgcgcaggcggttgagcaagggtataagcaggtaatatcctgcccgggatgtccagcgcttgaagaagttgctgccatacctgttgaatctcgaaaacgggtacagccgtggagcaagcaggaacttctttgcttcatcccattttcggaagttctgcgaagatataggtgcggaaccgcttccggtgctggcggcaggtgtaccttgtcagaattccgcttgtcatggcgatttgagaggcggtcagcaaggcggtatcccgatgagcgagatgggtgcttacattcaggatatcctcgacctgatagaatgggcgaacggtgatgcaaagaaaaccaaatggggcaagatacgtgccgaatccggtcatccgaagcctttcaatctgaaatatatcggcatcgagttctgcgaagatataggtgcggaaccgcttccggtgctggcggcaggtgtaccttgtcagaattccgcttgtcatggcgatttgagaggcggtcagcaaggcggtatcccgatgagcgagatgggggcttacattcaggatatcctcgacctgatagaatgggcgaacggtgatgcaaagaaaaccaaatggggcaagatacgtgccgaatccggtcatccgaagcctttcaatctgaaatatatcggcatcgagtgaattttgtgcgtgggctgtactcatttcaccgctgcaaaccttatcgtcgtaatatgcacaacggtcgtacacgtctttcagccgtccgctttccaggatcttgtcgagtgcccttaccggggcgttgtcgctcggatagcttaaagcaccgtaaacccaacggtaaacgaacgagtattgttgttgctggtcgcctcgcagttcttggggatttctcgcatggatgaacaggataatcgtgtcggctttcaggaacagttaaggcagaaccagagagccgacagtctgaaagcggccgcagccatgaaacggagaacggcgaaagcccggccgaaaaaggaaacgccgaagaaggaagagcctgaaaggacagtagggcgtttcttttcgggggaagaaccggagaacaagggaaacacgatagaggccattgtgtcgggcgatcagaagatcacgaacgggagcgtgataaaacttgtcacgctccaagaaatgcaactgcccgaggaacctgcgaggatgccgttgcctacctcagcaatcctccgaaagaaccttttatttgcattgcagattttcagaacccgcataatatctgcggattcatcggcgaaaacgcaggagtacacaccgaccggccgatcagcggaccactgcccgaattgccggacaactttgacgtggaagactggagcaatattccgactcccgtacaatatatctgttgcagtcaccgccgcatgacacaggctgcccattgaggaacctgcgaggatgccgttgcctacctcagcaatcctccgaaagaaccttttatttgcattgcagattttcagaacccgcataatatctgcggattcatcggcgaaaacgcaggagtacacaccaaccggccgatcagcggaccactgcccgaattgccggacaactttgacgtggaagactggagcaatattccgactcccgtacaatatatctgttgcagtcaccgccgcatgacacaggctgcccattgaggaagcggaattttatttgcagcttgatacggaactttacggggtgaaagcgtcggccaggttcgtaaagggaagcggccgggtgtatatttccgggtatgatgcgacaaggggcgagggcgtggcgctggaaaaaaacaacctggtgacgttccggccggatgcgaccgggcaggcggtgatcgagtttaccgtttcaagccgttacggtctgccagtgaaagagaatgtaacgatacaagtaaatcaatgagaggatattgcaggacgagcagtttacggcggcaaaccagatcgtcgcagccatgagggaacaaggttacacgcaccaggtaaggaagggggtgcattccttttcacgggagggtgaagtgttccagggtgaacacaggctcttgaaagcgttcgaacaacctctgtctgacgagcagctaaaaagcataacggaacgtttcgacttgacaaagtacgaggcgaacccggccgggtacagggagaacggtttgcagagggaaaaccgggagaaggccgggaaactgcaaacggatctcgaaatagcccggcaggagaaaggaactccggccgtcggatgcaatacgcacaagatcctggagatcgtggagcgtatcgacgaggagaagaagataccgacattcaacgatacggtttatgagatagaccgtaatacgctggatatgtgggtgaaaaggttaaaggacgaactaaagagataagcctatgtttgccaaagtacacccggccgaagggatatacatccgcccgtctggcatctatcgatgcgatgaacgaattgggtggtgccatcgtatctatcacactggtcatgatgtccgtgtttattccggtaagtttcatgggtggtacggcaggtacgttctatcgccaattcggtttgacaatggctatcgctatcggtctgtccgcattgaacgccttgacactgagtccggcattgtgtgccgttcttctgaaaccgcatactgatcatggagataagaagggatatacatccgcccgtctggcatctatcgatgcgatgaacgaattgggtggtgccatcgtatctatcacactggtcatgatgtccgtgtttattccggtaagtttcatgggtggtacggcagggacgttctatcgccaattcggtttgacaatggctatcgctatcggtctgtccgcattgaacgccttgacactgagtccggcattgtgtgccgttcttctgaaaccgcatactgatcatggagataagaggaaggatgcggcaagggattattcgttcaggatggtgcaggcttcctcttttgtgccgggaaagaatacgacggatatcgcgttggttatggatgcgatggacatccttcatgaggggcgggtcgggtgtttttgtctggtcgccagtgacggggattataccctgctggcacaacgtatcagggagagtggtctgacggtcctcggttacggggagggaaagactccggcggcactggtacgttcctgtactgatatcgaggacgtgcaaaggcggcataactgggtagggcagcagattcaggaggttatcatgctgccgttcaatattgcggcttatacgatactcctgtacgcaacgaaatatatatttttcttctttgcgtcagcccggtatctgtatcttatactcctggagatcgtcacgccgatagccgtaatactctacatggacgagaaaacgaggcattatacgcacgcatacctgaaaaacctgtttgtctgttacaggtcgttcacgagatcagcatcaaccccgattttatgaaccgggaagatcgggactggcattctaccctggtacatgaaatgtgccatttgtggcaggaggatttcggcaggccgagccggggagggtatcataattcgcaatgggctgacaagatgatccaggtcggactgatgccgtccgacaccggggaggccggaggcaaaaggacaggccagagcattacgcattatatcattccgggagggaagttcgacaacttcttcgtcttaattctcacactactcagccggaacttgacagaacgaatctgatcgctttgcaagctactctgaaaggtgatgcaattgatcaagatgagaaaaatgccgtcattacttctccgtatgtagctgtatatgataatattttggctgctgaagatgttcgtatcgctgataaggaaactttgtttgaaggtggtaatgctgctcattatgcaactacattcgatgcttgtacgaaagaagaacaacttgatctcgatctggaaagtacgggtagttgcgtcgatagtcggatagatcaggctgatagttcccttgaacagttcgtcgccatatacatccagcttcacatctaccggttcgcctttcttcaccttcgtgaagtaggtttcagacacattgatcatcagcttgaccggagtgatctgctctactaccagcaccggacttccgccactatacatatcaccattatcgtaattacgggcagtgattactcccaacttgatctcgatctggaaagtacgggtagttgcgtcgatagtcggatagatcaggctgatagttcccttgaacagttcgtcgccatatacatccagcttcacatctaccggttcgcctttcttccccttcgtgaagtaggtttcagacacattgatcatcagcttgaccggagtgatctgctctactaccagcaccggacttccgccactatacatatcaccattatcgtaattacgggcagtgattactcccaactggaacaggaagccagggaaaaccgggagaaggccgggaaactgcaaacggatctcgaaatagcccggcaggagaaaggaactccggccgtcggatgcaatacgcacaagatcctggagatcgaggagcgtatcgacgaggtgaagaagataccgacattcaacgatacggtttatgagatagaccgtaatacgctggatatgtgggtgaaaaggttaaaggacgaactaaagagataagcctatgtttgcgcccatgcggtcaaggtatttgaaagcatcttcggcgaaagcttcgtgacgcgcatcgccggggaaattcagttctacgtttttgttagtcagatcgattgctttggcagaactgtcaacggaatgtaccagctttgcacctccacgcatagcgtagaaggagaaaccgccggtgtagcagaacatattcagtaccgaacggtctttagaataatgctccagcagtgaacggttttcgcgttggtctacgaagaacacaaggtgcagcaacgtttgaactcggatctttcgatcgccggggttctgataacccagtacgacggaagaaagaacctgaacaagagcgtttcggaactggtacaggaaacattccagggcaaagtgttcagcacccatgtacgcaactccattgcgctggccgaagccccgacacaagggcaggatatttttcactatgcccccaaatctgccggggcagaggactacgagggtgtatgtaacgaactgctacacaaggtgcagcaacgtttgaactcggatctttcgatcgccggggttctgataacccagtacgacggaagaaagaacctgaacaagagcgtttcggaactggtacaggaaacattccagggcaaagagttcagcacccatgtacgcaactccattgcgctggccgaagccccgacacaagggcaggatatttttcactatgcccccaaatctgccggggcagaggactacgagggtgtatgtaacgaactgctatgcccaaagcattactgtactttttttcataaaatgaataaaattgttaataaatataattaataaaactcgattacaacactatatccacattcacatcatcccaatcatcaacgtccacatcaaatcccggaccgccacttcccggctcggatggtacctcataatcaaaattcaacaccagatgcacatcaccgatatgccccgctaccgggacatcatgcacttggtcgctcacgtcctgttccaatacagcaccaccccgaaaacggccgtccccttgttaatcaccatgccgccgggcagttgcatttcttggagcgtgacaagttttatcacgctcccgttcgtgatcttctgatcgcccgacacaatggcctctctcgtgtttcccttgttctccggttcttcccccgaaaagaaacgtcctactgtcctttcaggctcttccttcttcggcgtttcctttttcggccgggctttcgccgttctccgtttcatggctgcggccaccataaacagcagctgcagaagcatctttcaatatactgatcgtttcaatatcgttaggattcacattctgaaggctctgctcaactccgtcgatcagcacataaggttctcctttattaatagaccccgtaccacgaatattgaacttgatttcagcacccatttcaccgccgacaccatcagcgactgcatctgttgaaaaattcaagcctgcgacattaccctgaagggcactggtcaagtccgttaccgcaccccatcttcagcgatttccagaatgacaaggaaaagctggcaacatcctacgaacgcattgtccgttttctgtcattcatcggtctgccactcagcgtactgtttttctttacggcggaagaggtaacactgattatttttggtgatcaatggctgccttcggttccagtattccggatactttcactttcagtcggtattcagatcatactctcctcttcaggctctatttttcaggcagcaggtgatacacaccccatcttcagcgatttccagaatgacaaggaaaagctggcaacatcctacgaacgcattgtccgttttctgtcattcatcggtctgccactcagcgtactgtttttctttacggcggaagagggaacactgattatttttggtgatcaatggctgccttcggttccagtattccggatactttcactttcagtcggtattcagatcatactctcctcttcaggctctatttttcaggcagcaggtgatacacactacggtaaatgcgtgtggaaatgctaaatcagacgaactccaacttcccgttccatcggctgccgcaggcaatgtgaaggcgccggcaaatttgaaattatgaatcttgatcacgtcgatgtcctcctgcatgttatcgtattgggtctttgctttgaatacgacctgtgacagaatatgtttgaaattaaatttcactattccgttgttcatgtcttttgtctggcctttggccatggcatacatcacgtccactcttttcccagtcttccttatcgtggcgtgccaattgggcgtataacagtttgcgattcatttgtgtcgcagcctgtacgggatatttcaccagttcgaagtaagcactctgcctaccggcaggtactttagaagcagctttctctactgtttccgaaagttcgctgtaagcattcagacgttcgtttatctctctttcgctccacggtaagtctttgactacccgatagaccggattcttttcttcctccccactcttttcccagtcttccttatcgtggcgtgccaattgggcgtataacagtttgcgattcatttgtgtcgcagcctgtacgggatatttcaccagttcgaagtaagcactctgcctaccggcagggactttagaagcagctttctctactgtttccgaaagttcgctgtaagcattcagacgttcgtttatctctctttcgctccacggtaagtctttgactacccgatagaccggattcttttcttcctcccaaatattaattttgctgacacagtttaattgaattctctttttgctgttcatttgctttatttcaggacttcgcccttctcgttgaagaacacttcgctgtccgtgccttctgcatcggtaaatgtccccttgtaggtctttgtgccttcctcgctttcctcaactgcggcttccttgattgtcaggtctgcgaaatccttcttgatcgtgtcctgaaccgcctgcggcagatcctttacctcgattggcttatattccgcttcgttttccgtttcttccggatgtgcctcgctccccggcgtttcctgctgtggctgctgcgcttcctcctttgtttccggctttccggtcacgcttttatcctcttccggctcgatcggcactttctggtatgtcaggaaagaaatattcttggcttccaggccgttttcccggtaggccacgccctcctgcttgtacttgtacaggttaaaccgttcgataatgccctccatgtggcggctctccaggacagaggacaatcagggcgcatacttcccgcgtcccggaacgggagacgaacaaaaaacggtatatccttcgctgagagtacacgacggctccttcatcaagatcaagaatatcactttgggatatcccctccccgccaacatttcccgcaaggtattgatggagaaatgccgcatctacgctacggcctacaatccgttcatctttgtgaaagacaagcaactgaaggacacagaccccgaaacgaacggttccatagaatgatattgccatctccaaagctttcaagggcccctccgtctcaagagttttgtaaagcgcatatcccacgatggcacgacttgacgcatcggtaagcaacgagaggtaagcccagccctgaccggtgtttacgtaggttatatccgccactaccatagcgcccaatcttgtagcgacaaatttgggtgcaacattcaacagatcggggtagatatagtaattatggttcgaattcgttgttttaggaccatagaatgatattgccatctccaaagctttcaagggcccctccgtctcaagagttttgtaaagcgcatatcccacgatggcacgacttgacgcatcggtaagcaacgagaggtaagcccagccctgcccggtgtttacgtaggttatatccgccactaccatagcgcccaatcttgtagcgacaaatttgggtgcaacattcaacagatcggggtagatatagtaattatggttcgaattcgttgttttaggaccatagagatttggaatgtaaatgcggctgtagagaaaagacttatagcgattgtattaatcgttcttaccagctggctgggactacttttctactacttctatggtaaagaaagaatggcgggatggttgaagtagtgtttgcatatcaatctttctcaggaatccaactgttcaccagttcctgatgttcttccatccattgacgggcagcctgtctttccgttgtctgcgcctcttccagagcagtcattaagcatagagatttggaatgtaaatgcggctgtagagaaaagacttatagcgattgtattaatcgttcttaccagctggctgggactacttttctactacttctatggtaaagaaagaatggcgggatgggtgaagtagtgtttgcatatcaatctttctcaggaatccaactgttcaccagttcctgatgttcttccatccattgacgggcagcctgtctttccgttgtctgcgcctcttccagagcagtcattaagtttcccctgactggtctgataggcagtcagcgcatcattcacttcgctgccagcgttgagcaatgtttgctgaaagccgagagctgcttcttcctgttgcgcacgggcgatacgatactgagccaccacctgtcctttattaaagagcggctgcgtgagcgaacctaccgccgatgccaggaacttgcccggattgagaatcatagacccgacggagttcgtccatccggcacttccgctcaacgtgatggaaggtttcccctgactggtctgataggcagtcagcgcatcattcacttcgctgccagcgttgagcaatgtttgctgaaagccgagagctgcttcttcctgttgcgcacgggcgatacgatactgagccaccccctgtcctttattaaagagcggctgcgtgagcgaacctaccgccgatgccaggaacttgcccggattgagaatcatagacccgacggagttcgtccatccggcacttccgctcaacgtgatggaaggcattcgcgatatcggtcacttccgcgcgggtcggacgaggattgttgatcatggtatgaagcatctgagtcgcaacgatcaccggtttctttgccaggatacatttgcggatcagcacacgctggatccccggaatacgttcctgcggcacttcgatacccaggtcaccacgggctaccatcacgccgtccgccacttcaagaatctcgtcgatgttgtccaccccttcctgattctcaatcttggcaataatcccatttgctttatttcaggacttcgcccttctcgttgaagaacacttcgctgtccgtgccttctgcatcggtaaatgtcaccttgtaggtctttgtgccttcctcgctttcctcaactgcggcttcctggattgtcaggtctgcgaaatccttcttgatcgtgtcctgaaccgcctgcggcagatcctttacctcgattggcttataatcgttcaccattaccacaatctcaacatccgataccatgttgccggcgcatgctgccatcttgctgtcctgcaagaacttttcggcagcctttgaatgtttggtactcatgattgcgacgctaaaatttcgacaatgtggataatttgaatcggcagatgctcccgtttgatcacgccttgcatgtgcatcaggcaggaactgtccgctccgacaatgtattcggctccggtagccatgtggtctttcaccttatcacgccccatgcagacggacaccgcctgctcttctacggcaaacataccatgctgccatcttgctgtcctgcaagaacttttcggcagcctttgaatgtttggtactcatgattgcgacgctaaaatttcgacaatgtggataatttgaatcggcagatgctcccgtttgatcacaccttgcatgtgcatcaggcaggaactgtccgctccgacaatgtattcggctccggtagccatgtggtctttcaccttatcacgccccatgcagacggacaccgcctgctcttctacggcaaacataccagcaaggcgacagggctttctattctcctttagccgattatatcgtagtgccgcttcgctcgcagttcgtcgatatgcagagcttttacgaaacgcttctgcatgaaatgggacattccacgggacgccccacccgattgaaccgggatcttgcgcacccgttcggatcagaggaatacggcaaggaggaattaacggccgagttcgccgcagccctggcaggaatgtttttcgggatagccgaacatatacgccagcagttggcagagcaggatactgtagttaaagccttgcagcggctttatgaaaatgcccgtatggcggtaggaaaggatgtgaaagcattgcgtcagcagttgcaggaaggggaggcttgtccggtttgtggaagtacgacacatccttatcatcgggaacaagaggtagtggatactctttaccggaatatggaacaggaatataataccgcagtgtctgcttatcagcagataaataatcgcagcattgcccagcagttggcagagcaggatactgtagttaaagccttgcagcggctttatgaaaatgcccgtatggcggtaggaaaggatgtgaaagcattgcgtcagcagttgcaggaaggggaggcttgtccgggttgtggaagtacgacacatccttatcatcgggaacaagaggtagtggatactctttaccggaatatggaacaggaatataataccgcagtgtctgcttatcagcagataaataatcgcagcattgccagttattgatggatgttcacggaacaggttgctatacttcgcaggcagccatgaagctgtacaaccggcaaaacgaacagttgggcgatgcagcagaaagagcggcggtcgctgccgaatggttggggactgccagctatccgcaacacacgctgacggaggcatggaaacgtttcatcttccatcaattccatgatgacctgacgggaacgagtatcccccgtgcctatgagttctcatggaacgatgaactgacagccgtttccttcgacagacggctcgggatctaccggttcgaaattgggaagctgcacatatacgaaaggaaaatcaccgattccccatttctctctccaatccgtaatcatccgggagaacagggcagcatattcttttccagagccgccggagttaaattctccctgataccagatgactccctttatactcaaagggattaaaggagaaatcattgcgttaaacagattggacggaccattatttcccccacagtacaggaacgtaccagtgccgccggagtctttccctccccgtaaccgaggaccgtcagaccactctccctgatacgttgtgccagcagggtataatccccgtcactggcgaccagacaaaaacaaccgacccgcccctcatgaaggatgtccatcgcatccataaccaacgcgatatccgtcgtattctttcccggcacaaaagaggaagcctgcaccatcctgaacgaataatcccttgccgcatccttcccagtggtgctgggacacagccctaatgaagatgtgcagcggcaggtggcggatgtgctctttgccaaagctacggcggacggaagattatcggccagtcttggagaactctttcaggcaggagacggtgtcacgattactccgaaaacacctttgcattttattccggaagaacatgggctttcttctgtcgccctgcaacgaattgattcgatcgctttggacggtgtacgtcagggagcttatcccggttgtccagtggtgctgggacacagccctaatgaagatgtgcagcggcaggtggcggatgtgctctttgccaaagctacggcggacggaagattatcggccagtcttggagaactctttcaggcaggagacggggtcacgattactccgaaaacacctttgcattttattccggaagaacatgggctttcttctgtcgccctgcaacgaattgattcgatcgctttggacggtgtacgtcagggagcttatcccggttgtccaggaaggtcgatttccccgtttgccgtcagacaaccgaataccactccgtcagctcccaactgccgtgccatttctatatctttcagcatcgttctcacttcgatgggagaataaagaaaatccccaccccgcggacggataatgacatgcagacgagtcgttgtcagcatgtcgcgtgctgtcgatatctctccgtaagaaggagtcgtcccgccttccggaatacctgcacataactctacccggtcggctccaggaaggtcgatttccccgtttgccgtcagacaaccgaataccactccgtcagctcccaactgccgtgccatttctatatctttcagcatcgttctcacttcgatgggagaataaagaaaatcccccccccgcggacggataatgacatgcagacgagtcgttgtcagcatgtcgcgtgctgtcgatatctctccgtaagaaggagtcgtcccgccttccggaatacctgcacataactctacccggtcggctcccccacacgttacagccgcacccacaggtgtatttcttccgctttccgcttttgctctccccctcgtccggatcttccggttcttccgtttcgtccccgtcgcttccggcgatgcggatcggccgggcaggtacggccgccaaagtcggcttgtacctaagccgcaagttttgcagatcctcccggcttagcgtattgaaaacctgctcgaacttccctcccggaatgatataatgcgtaatgctctggcctgtcgcacaactatcgtaacaatccctgtgtagtgatgtggagtatcggtaatgaagtccccacgcaatgcagccctgtaggatataaagtagccaagttcctgcaagatatctgccaccgtgaagaccctccccgccccgttacctgcggcatggaccaagtgacttgtgttctagccaacggatttgctgccatgatcgatatccccggtctgaactaccgcgccaatcgctatcaggaggcatatgacaaacttccgcgttacgtcaaaaagggtacaaggttcttttgatcgaccttgacgggcaggccaacctgaccgaatcgctgggcttctctgcggagcttccccaaacgatctacggtgcgatgaaaggcgaatacgccctgccgatctacgagcataaggacggccttagcgtcgttccctcctgcctggatctctcggccgttgaaacggagttaatcaacgaggccggacgggagcttatcttagcccaccttatcaaaggcccttgtcctcgtacatttcaaacctcaaatgaaagttcctcatgttggaatgtgccgcactccccacgaactcgcccgatttcaggctggtaaagaaattcgtgtcgtatatttcctctttctgcgtagaaactgtacggctgcggttctcccctccccggctgcttccggtggtctttgaaaccctctgcctctcctcttttccaaaaacaagcgggtagcttttcaaggcctctatgtcctttgtccggccaacgcaactggcatcgtcagacttccgtacacaacaccgtgactctggacaataagaatctggaaacaaccgaatctgttactaaactgtggcagccggaaggcaatatccagaccttggttacagaaaccccaagctacaagaacttcaagcaccgccgttcggtcttcttcgtagacaatacctactttgtcattgtagatgaagtatcaggcagcgccaaaggttctgtcaacctgcactatcagatgccgaaaccttggtggcttcccaactataaaacgccatcatgtcttcactaaccgttccgggattgaacgcgtaaaagtccaaagcctcggtaggccaataacgaaggtcgctcgcattgtcataatcccacttcccatttttgtacacgatcttcactccgtcatgttcaaattccgtgtcgttctttcccatgaaggcagtaccatccgccgtaaaagcgaacacgtcgaaatcggtgttcttcaagttggtgttggtagtatgttcttcacctgtccgcccgtttgtccggggaaatagcgtgccgccatctcatacgacttttccatcagttccagcgggtcttgtcctttccgttcacgttccagcttttcgttaagctcctttacctgccgttccagttcgtccaccctcggactctccttcggttccttatagaacgaggtgatctgtcttgaaatctgccgctgtttttctctggactcccggatagcatccgctttcggtacatcttctatgttcttcacctgtccgcccgtttgtccggggaaatagcgtgccgccatctcatacgacttttccatcagttccagcgggtcttgtcctttccgttcacgttccagcttttcgttaagctcctttccctgccgttccagttcgtccaccctcggactctccttcggttccttatagaacgaggtgatctgtcttgaaatctgccgctgtttttctctggactcccggatagcatccgctttcggtacatcttcctcgggctgggcgtgaaacgcgagacgctgctgaagctcttcgagcagcacaacgaggagttcatcaagaaagtgggacacagccgcgtgcagggaacatacaaccgctaccgtaccatatacaggcacctttgcgagttcgtcccgaaagtataccgccgtgacgacatccccctgaaggaactcaacctgaccttcatcaacaacttcgagtatttcctgcgtacggagaagaaatgccgcaccaataccgtagacacccgtaccgtagtagagcaggaaagggatcgcccaggggttgagcgtcagggctacccggtttgtgcctttgatgttgtgtaccgtcgttatcaccaccccgaacgtttccaccgtctggtggatattgggatgcacccagcgaaaggaaaagtttttccgcatcatggcgatagcctctttcagaactttgctcttgttgttcttccccccggcttcgtcgcatttgatctcgacgacaggctggttaaagctgtgccccgctcattcctcccaaaccggaagatacgaagaggtgaccacgcaaatctttgtcctgcggaatgccgagtttcaatcgcccggcgttgagtaatgtgttgaaagtgccatgaacaataccctgcggaccgatatacatccagccgcccgccgtcatctgcccatagttggcaactcccatttgtgcggcaatgtgccaatcgtgctgattgtcgaactggcctatcatcatagagttggtaataagctgtgccccgctcattcctcccaaaccggaagatacgaagaggtgaccacgcaaatctttgtcctgcggaatgccgagtttcaatcgcccggcgttgagtaatgtgttgaaagtgccatgaacaatcccctgcggaccgatatacatccagccgcccgccgtcatctgcccatagttggcaactcccatttgtgcggcaatgtgccaatcgtgctgattgtcgaactggcctatcatcatagagttggtaataaccggacggattcaaccgttatattgatcctgtcctgtgcgagcttcaccaccccgaaaacggccgtccccttgttaatcaccatgccgccgggcagttgcatttcttggagcgtgacaagttttatcccgctcccgttcgtgatcttctgatcgcccgacacaatggcctctatcgtgtttcccttgttctccggttcttcccccgaaaagaaacgtcctactgtcctttcaggctcttccttcttcggcgtttcccggatctgcgtgccacggatattccggataatggaaactgcactctccaccgattccagaaactcggccagcctgtcccggtctgccttcgccagtttctcgctatacgccaacgggttggcctggcacgctttttcaaggctttgcagtcccgaaagcgtaaaggacaatatgcagaagtgatgcaggtattcccgtccgtcgaaatacttcctttcggccgtctgtatatagccctccccctcgatcacataccgggaagtgaagacatggatgccgcaaaatggaaaccaaatctgaaaatcaaggaactgcgtctgcaccgggaagcccgactggatcagtgggaaggcaaagccggactggtatggcgtgtagctttctccacgaagaaggaggaaataggggagcaagattgctatgccctttcacagattatcaacctgacagatccctttaaaaatagtccgagcgacaattttaaagagagaacactgacagctactctcccgggaagtgaagacatggatgccgcaaaatggaaaccaaatctgaaaatcaaggaactgcgtctgcaccgggaagcccgactggatcagtgggaaggcaaagccggactggtatggcgtgtagcttcctccacgaagaaggaggaaataggggagcaagattgctatgccctttcacagattatcaacctgacagatccctttaaaaatagtccgagcgacaattttaaagagagaacactgacagctactctcctaagcctgacggcgaaaagcgttgccgaggaaatggggatcagccgccagcagctttgcaacatcgagcagtcggaaaccgcccccgtggtggtgaaatacatcgcttttctaaggagcaaaggggtggatctgaacgctctgtttgaccgtattatcgtgaacaaataaaataaatcgtatgagaaaattagttaccgccttgtgcgctttggtctttttgtcgtcttgcgacgacgaactgaaacttgtcagctaagcctgacggcgaaaagcgttgccgaggaaatggggatcagccgccagcagctttgcaacatcgagcagtcggaaaccgcccccgtggtggtgaaatacatcgcttttctaaggagcaaaggggcggatctgaacgctctgtttgaccgtattatcgtgaacaaataaaataaatcgtatgagaaaattagttaccgccttgtgcgctttggtctttttgtcgtcttgcgacgacgaactgaaacttgtcagctatcaatactttcttccacggacgtttcggacagtcagtcgtgaatacggctcgtatgaataatgagtccatgcacggtaacgccaatcagagtacggctgtgttgagaagatggaagaacgaaggtgatattacagatataccgcgtgcattgtatggcgaaggattcaactatttaggttctgatcgttttgtggaagatacttccttccttcgtttgaaacagttgacactgaattatgcatttccgaaaactatcaatactttcttccacggacgtttcggacagtcagtcgtgaatacggctcgtatgaataatgagtccatgcacggtaacgccaatcagagtacggctgtgttgagaagatggaagaacgaaggggatattacagatataccgcgtgcattgtatggcgaaggattcaactatttaggttctgatcgttttgtggaagatacttccttccttcgtttgaaacagttgacactgaattatgcatttccgaaaactcaaagtattataatgataaggcctattttgatgcggtgcagaacggggcggtctataaatgcgagatagacagcatccagacgatcgccggggacaatgagccgtacaaggtggctttcacttccgccctgacgatttacggcgtttcggggcagaagctaaggtttcttatcaggacgaaaggggagatcgtgagaaccacgccgcaatttccggagaacgtgacgggatttttctttaaccagtttatacactcactatgattacgattatgaaacagagaaatatattcctgtagaaatcctgccgaacgagttcaacggctattcaaaaatctccccattgatattcagtaatggattcaagagactgtttagtgtacctgccgattcgcagctgacagatacgatgtacgaacagtatccctatctgaaccaagaacacgataaggctacattgaccgctgccctgatgcaactggaaaaagaaagccagatgatgacggaagctcactatgattacgattatgaaacagagaaatatattcctgtagaaatcctgccgaacgagttcaacggctattcaaaaatctccccattgatattcagtaatggattcaagagactgtttagtgtccctgccgattcgcagctgacagatacgatgtacgaacagtatccctatctgaaccaagaacacgataaggctacattgaccgctgccctgatgcaactggaaaaagaaagccagatgatgacggaagctcattgatttacttgtatcgttacattctctttcactggcagaccgtaacggcttgaaacggtaaactcgatcaccgcctgcccggtcgcatccggccggaacgtcaccaggttgtttttttccagtgccacgccctcgccccttgtcgcatcatacccggaaatatacacccggccgcttccctttacgaacctggccgacgctttcaccccgtaaagttccgtatcaagctgcaaataaaattccgcttcctgaaataccatttctgccacttcaagctgcccaagcagaaggagacaacaccgaaagcactcagccgtgagaatttcgagaagctgcgtgatctggagataccggaaaaacgcaggtcacatgtcatcacccgggacctcttcctcttcgcctgttacaccggcaccgcctatgccgatgcggtaagcatcacccggaagaacctcttccgggatgacgagggcagcctctggctgaaataccagcgaaagaaaacctccttcccgtcccggaaaacaaggctctttttctcgatctcctttccgtttttgtaaacggtcactacccactgcatcggctcgttcacaacgccgtcctctccgtccacgacaccaccggaaacgacaaactcgatcgcctttcccgtcgtgcttaacgtcaccttttcgacggccagttcttcatcgcttagaatcaccgggcttgcgaggctttcccccgtcgccccgtctttcaactgcgtaccgttggcctccggccgtttctcccctatctcatagacgaacgcctccggctgctgccgataatccacgttgaacgtgtagaacttccccccttcggtcgccagcgacacgtttgtctgcctgggaaattcctcctcctttcccgtggctgcgatcattcgcacgatattctcggtattctcggccttgcttacctgtatgcaggtatcgccgtaatctatataaatcaccttttccggtgcgatcaggtgcgtttgcgacacctctaccgtcttccatgcgctttaccgtgcaggcggtgtgagtgatatcggcagcctccgaaacgttcagttggtacgcaacggaaagaatatcgccaccatcgacgtttatgaatttatcatgaaaggcaacacacaggatgacatccgccttcaggaaggtgacgtggttatcgtccccgcctacgatgtcttggtaaagatcagcggcaaggtaaaacgccctatgcgtttcgaaatgaagaaagacgagaactctaccgtcttccatgcgctttaccgtgcaggcggtgtgagtgatatcggcagcctccgaaacgttcagttggtacgcaacggaaagaatatcgccaccatcgacgtttatgaatttatcatgaaaagcaacacacaggatgacatccgccttcaggaaggtgacgtggttatcgtccccgcctacgatgtcttggtaaagatcagcggcaaggtaaaacgccctatgcgtttcgaaatgaagaaagacgagaattccccgtatgcctcctgtccggtaaacacgtccgaccgggtgcactctttcgccgccagttccaacatttccccctgcatggaaagcacctgcaacaccattttagagtttttgataaccccgttcccctgccggtacagatccaggctcttagtcagtatgtccctggattcccccagcacttgaaactgttcgtatgcctgtttaagttctttcgcccaggttatctgcgatagctgcgtcaaggccggatcctcgtactttgtcaagtcgaaacgttccgttatgctttttagctgctcgtcagacagaggttgttcgaacgctttcaagagcctgtgttcaacctggaacacttcaccctcccgtgaaaaggaatgcccccccttccttacctggtgcgtgtaaccttgttccctcatggctgcgacgatctggtttgccgccgtaaactgctcgtcctgcaatatccttttaagctccgggttcgtgatcttcccgatctcggcctcgggctgggcgtgaaacgcgagacgctgctgaagctcttcgagcagcacaacgaggagttcatcaagaaagtgggacacagccgcgtgcagggaacatacaaccgctaccgtaccatatacaggcccctttgcgagttcgtcccgaaagtataccgccgtgacgacatccccctgaaggaactcaacctgaccttcatcaacaacttcgagtatttcctgcgtacggagaagaaatgccgcaccaataccgtacttatccagccttgaaattggaaaaatgcaattcaaattcaacgagtgtgatattgtagcgctatgcagaaatgtcatcgacatggtagagaaaataaagcagactcaagcggaagtacggttttccacctctctcagttcactgaagctgaccacggacagtgcccgcctgcaacaagtactgatcaatctgcttatcaacgccacaaagtttactgcacaaggcactatcaccctggaactggtgaaacaaaccttcagagaactataaacctcgggaaacgaaagtcccttggaaagcgcctgtttagctgcattggcagccaaatggttctgctgtatttcagcctcatattctcttaaaagagcatacatatcatctaccgacggattcgcagataacttgcccgcctgcggaatattccttgctttcgaagtatcattagcatcatccggtgccgtacgtggtaactttctttgctctactttagtcaacaattcatttttccgcttcagagaactataaacctcgggaaacgaaagtcccttggaaagcgcctgtttagctgcattggcagccaaatggttctgctgtatttcagcctcatattctcttaaaagagcatacatatcatctcccgacggattcgcagataacttgcccgcctgcggaatattccttgctttcgaagtatcattagcatcatccggtgccgtacgtggtaactttctttgctctactttagtcaacaattcatttttccgctttataatatctttataggctcgatcatcggccgggaaaacaacctgaatccggactacctgtttctttcggatctgcattcgtcgctctgcatggggatcaattactctacgttccgcagcgacacggaggggatcttgtttaacgaacggctgtatcaaacaccgattcgaaaggacgtttgggacgcagataagaaacgcattccggcacgtaacatgattatcgtcgcatcgacgggtgggggaaagtcgatttcaaacctgtattcggcaaaaagagccactttcgggcttagcaacatttccggccttatcccgacctcgtacccatacacgaaagccttgcttttctccaggtacacaagatcgcttttcgccttggctttctggtagccgatcgtcccggctgcgatccccaggagcgagaatttccgtcctttcagggcgtaataggccagctccgggccgaccgtcacggtgtttgcctttaccagatcccggtttagactgaaaggaaacaaatcgcacgatgcgttcgtggccgaaatgttactctattttgaaacaacggggatcaccccgcagtcgaatgtaatgccgccgaacattgcggccaaagagcaggcaagccgggcgatcgaagttgtccggggcattgagaaatccactaacgtaaggctgaaaaacatcgaacaactccttttgtcgcttgtcggggaagtgaaaacgccgggggacaatccggacgaatatatgcacatcctgatagtgtgtccagcactttcttgtattcctgcaggtacttcaggaagtttttgtttctagtggcggaacaagataaggctatttcttggagcacgcttttgcgcgattccagggaggcggcgggtggcagaaggcggtaggcttcgaatccggcctcttcgccttctttaaagcgggcggtcatcatataagcagtcatcaggcatagtttggccgatgacattccttggggattgtttaacttttgtgccactgatagtgtgtccagcactttcttgtattcctgcaggtacttcaggaagtttttgtttctagtggcggaacaagataaggctatttcttggagcacgcttttgcgcgattccagggaggcggcggggggcagaaggcggtaggcttcgaatccggcctcttcgccttctttaaagcgggcggtcatcatataagcagtcatcaggcatagtttggccgatgacattccttggggattgtttaacttttgtgccactgatcagctgtgggttagtgatatcacttacattaccatatggttgcctgacggcagttatgtgttctgctacctgtctctggtgacagacgcctatacgaaggagatcattgggtattgcgtaggcgatactctgggaagctgttacacagtggaagctctggaaatggcagtcagacgcatagctgcaaaggagattaagggtttgatccatcactccgaccgaggcgtacaatatgccagtgcggattatactgcttctgccgaaacaactcccgatacaatcggggaactggcattaggattgaatacagtctggatgctgcttgcggcaatgctcgtattttttatgcagccggggtttgcattggttgaggcgggttttaccagagtcaagaataccgccaacattttgatgaagaactttgtggatttcatgtttggttccttgctctactggttcatcggtttcggtctgatgtttggtgcgggaggtctcatcggaatgcctgcttctgccgaaacaactcccgatacaatcggggaactggcattaggattgaatacagtctggatgctgcttgcggcaatgctcgtattttttatgcagccggggtttgcattggttgaggcggggtttaccagagtcaagaataccgccaacattttgatgaagaactttgtggatttcatgtttggttccttgctctactggttcatcggtttcggtctgatgtttggtgcgggaggtctcatcggaatgcctgtattggaacaggacgtgagcgaccaagtgcatgatgtcccggtagcggggcatatcggtgatgtgcatctggtgttgaattttgattatgaggtaccatccgagccgggaagtggcggtccggggtttgatgtggacgttgatgattgggatgatgtgaatgtggatatagtgttgtaatcgagttttattaattatatttattaacaattttattcattttatgaaaaaaagtacagtaatgctttgggcactggacaccggaaaatccgaccagtgacatccctgcggctaccaactcctcttccaaccgtgtgatctcttcacgcatcatcgaagacggttcgtacctgcgtctgaagaacgtaacagtaggctataccttccccgccaagctggtgaagaaatggaagatagacaaagcacgtgtttacgttgccgcacaaaacctgtggacatgtaccggttattccggttatgatccggaagtatctgtacgcaacagtgcctggacaccggaaaatccgaccagtgacatccctgcggctaccaactcctcttccaaccgtgtgatctcttcacgcatcatcgaagacggttcgtacctgcgtctgaagaacgtaacagtaggctatcccttccccgccaagctggtgaagaaatggaagatagacaaagcacgtgtttacgttgccgcacaaaacctgtggacatgtaccggttattccggttatgatccggaagtatctgtacgcaacagtgcctggagagccgccacatggagggcattatcgaacggtttaacctgtacaagtacaagcaggagggcgtggcctaccgggaaaacggcctggaagccaagaatatttctttcctgacataccagaaagggccgatcgagccggaagaggataaaagcgtgaccggaaagccggaaacaaaggaggaagcgcagcagccacagcaggaaacgccggggagcgaggcacatccggaagaaacggaaaacgaagcggaacgaacagctgaaacagactgccggaatctctctgacagaggccgaaagcgtggatggaaagcctgctatcagtttcgtactacaagaaggtatgcctaaagaaggttacaagctgtctgtcacccccacccttattacagtcacagcttcccagccaaatggatttttctatggtgtgcagactatttatcagcttcttcctcccgccgtatacggaaaagagctgaagaagaaagccgactggtctgttccggccgaacagctgaaacagactgccggaatctctctgacagaggccgaaagcgtggatggaaagcctgctatcagtttcgtactacaagaaggtatgcctaaagaaggttacaagctgtctgtcacccccccccttattacagtcacagcttcccagccaaatggatttttctatggtgtgcagactatttatcagcttcttcctcccgccgtatacggaaaagagctgaagaagaaagccgactggtctgttccggcgatccgaagtacagttgttgcaatgtaccatggctacgaggcttccgtcgggagtggtgaccatgtcgatcatttcgtatggcttcgacaattctttttccaatacgatcatagagaaagaagaagtacctgccgatacgttgccggtgcgttgcttgacggcgttggttgctaccatgccggtgcctgcgtctccttccggtgggcagaccggtattcctgccttcagatgaccggatgcatcgagttttttaccgcaactggcatcgtcagacttccgtacacaacaccgtgactctggacaataagaatctggaaacaaccgaatctgttactaaactgtggcagccggaaggcaatatccagaccttggttacagaaaacccaagctacaagaacttcaagcaccgccgttcggtcttcttcgtagacaatacctactttgtcattgtagatgaagtatcaggcagcgccaaaggttctgtcaacctgcactatcagatgccgaaacgcagcaaaggagtaactgatgccggcatttgcatcacacggtcttttataaaaggagtacggggagtagaaagccgcatatatcttcctgggataaatgtcggattcaaggaagaattatatatataccccgcctcatatacagctttttccgacacaggcatcatgcgtgcctgccgatagccataaactttggttccggtgatttcctccaactgatccttcgaccttttcagatcttctacttcaaaggtccgcagcaaaggagtaactgatgccggcatttgcatcacacggtcttttataaaaggagtacggggagtagaaagccgcatatatcttcctgggataaatgtcggattcaaggaagaattatatatatcccccgcctcatatacagctttttccgacacaggcatcatgcgtgcctgccgatagccataaactttggttccggtgatttcctccaactgatccttcgaccttttcagatcttctacttcaaaggtccgcaggacgagcaggctatctacgaaatggttgccgcacgcctgctcgaagccttcttgccatgttgcgtcaaggaaatgaccgaagttgccttgtccgcaggcggtgagatattcactctcaagggtgcggtcatcaagtccgccggttggcgtgccgtgcgtggcgagccggaagaggaggcggaggaaaccacgttgccaggactgcaaacgggtgaaaccctgccactgctcgcctccgaaacagtggagacgcaggacgagcaggctatctacgaaatggttgccgcacgcctgctcgaagccttcttgccatgttgcgtcaaggaaatgaccgaagttgccttgtccgcaggcggtgagatattcactctcaagggggcggtcatcaagtccgccggttggcgtgccgtgcgtggcgagccggaagaggaggcggaggaaaccacgttgccaggactgcaaacgggtgaaaccctgccactgctcgcctccgaaacagtggagaggctgttggataacggctggttgcaggaagtaatgaaaggctggtatattgcggccaggccgggaacagagggggacacgacggtctggtacacctcattctggtattttattgcgaaatacgcggccgtccggctgggggaacaatggtgcttgacggccgaccagtcgctggatctgtattcggggaaaacgaccgtgcccgtacaggtggttatcaagtcgccgaaaggccataacaacacgcaaaagctgacgtaccaagagcgaccagctggtgggcggctatatgattgtcagcagcaatgtatggagcgtgcgtgaaatccgtttttcggggcggtcggaactgattacgtttacttgctggatcaagatggggggagtaggaaagaaagatgaatttctcccgatacgttatgacgtggaggccctttttaagttcctgggaaataaggtggacggcaattataccgcctcgctggactataaatcgatagaactgaaagaacgtaccaagagcgaccagctggtgggcggctatatgattgtcagcagcaatgtatggagcgtgcgtgaaatccgtttttcggggcggtcggaactgattacgtttacttgctggatcaagatgggggaagtaggaaagaaagatgaatttctcccgatacgttatgacgtggaggccctttttaagttcctgggaaataaggtggacggcaattataccgcctcgctggactataaatcgatagaactgaaagaacgttcctgtattgtctacaatgttgtagtgtatgaattggcgggttgcataatcgtagcggttgatgcttccgtcggtagcaatccataactgctgttctttgtcttcgtaaatatgccggatgcggttgtgagataatggataagtcttgtcgcccattctgtaccaaatggcatcgtgtctttctccggcaggatcagtgaaacgaattaatccgttggctcctccaaaccaatagaacccttttgagtcacgcgttcctgtattgtctacaatgttgtagtgtatgaattggcgggttgcataatcgtagcggttgatgcttccgtcggtagcaatccataactgctgttctttgtcttcgtaaatatgccggatgcgggtgtgagataatggataagtcttgtcgcccattctgtaccaaatggcatcgtgtctttctccggcaggatcagtgaaacgaattaatccgttggctcctccaaaccaatagaacccttttgagtcacggtcatatttcccgtatatcttctcgatcttcgccgccgactgcgtgaggaaaacgaaactgcaaaggtattcccttagaacggacggcagtttctcgaaatcggcgatccggaacgtggtcgcttcatccagaaagtagaagaacggcactttgttcgccagcgtgaaacgccgggacgaaatggaaagcatgagcgatataaccggggaaatcaggttttcgatctgataggcgttcgatacgacaaccaattttacctacatcaagggggaaagttctttctttatggaacgccgggatttgcttgcctttaccgggtacgccaaagataccggaggccgggaaaggggaacgcaccgaagcgcagacaagacggtcgggtttatcggtggtaaggccaaacaaaagctgataaacgagatcctgggggatagcttccggacggaaaggatgcttgtaggcaacgtgaaaaaggccgtcagccttatacagaacccggctaatataaatacaagaaagtactgatcgaaatcgcccgcgtatacaacgaagcgatgaacatcatccactatatgcacgacaagtattattacgagaaagcccagatggctcttgtagatacgaacccgcgcataaaccttgcttacggtgtagccggactttccatcgcactcgattcactgtctgccatcaaatatgcgaaagtaactgcccgccgcaacgatatcggtctgacagaaggcttcgacatcgaaggagaattctacaagaaagtactgatcgaaatcgcccgcgtatacaacgaagcgatgaacatcatccactatatgcacgacaagtattattacgagaaagcccagatggctcttgtagatacgaacccgcgcataacccttgcttacggtgtagccggactttccatcgcactcgattcactgtctgccatcaaatatgcgaaagtaactgcccgccgcaacgatatcggtctgacagaaggcttcgacatcgaaggagaattctaccacgatctgctcgatgtctttgatgcgggtgatcatcccttccgaacggatgtaataggcattctttgctttctcgatgtagcttccgcccgtgttctggttgttgctgctcagtgcttcgaacacttcgccgatggtgatgttcagtgaaaacagggcgtcggggtctaccgccacttcgtattgtttcagataacctccgaaactgtttatttccacgatgcccggtatgcccgataactggcgtttcactaccacgatctgctcgatgtctttgatgcgggtgatcatcccttccgaacggatgtaataggcattctttgctttctcgatgtagcttccgcccgtgttctggttgttgctgctcagtgcttcgaacccttcgccgatggtgatgttcagtgaaaacagggcgtcggggtctaccgccacttcgtattgtttcagataacctccgaaactgtttatttccacgatgcccggtatgcccgataactggcgtttcactacctacatcaagggggaaagttctttctttatggaacgccgggatttgcttgcctttaccgggtacgccaaagataccggaggccgggaaaggggaacgcaccgaagcgcagacaagacggtcgggcttatcggtggtaaggccaaacaaaagctgataaacgagatcctgggggatagcttccggacggaaaggatgcttgtaggcaacgtgaaaaaggccgtcagccttatacagaacccggctaatataaatatatcctttacctgcaaaccgttctccctgtacccggccgggttcgcctcgtactttgtcaagtcgaaacgttccgttatgctttttagctgctcgtcagacagaggttgttcgaacgctttcaagcgcctgtgttcaacctggaacacttcaccctcccgtgaaaaggaatgcacccccttccttacctggtgcgtgtaaccttgttccctcatggctgcgacgatctggtttgccgccgtaaactgctcgtctatcaatggaacgaagtacgatatggaactcgtgacatggtttgacgtatacttgtaacggcggctgcccattcaactcaatcgccagattgactacacttcctcccgaatagagagagtaaggaggtgtatctgtccatcctcctgcaacgtcaatgcgcaccggactacgtccccatacgatctgatccgaataaacattgagcttcggatagttcttttttccggcaacggcttccagtaatccgtcacggatatcaatggaacgaagtacgatatggaactcgtgacatggtttgacgtatacttgtaacggcggctgcccattcaactcaatcgccagattgactacacttcctcccgaatagagagagtaaggaggggtatctgtccatcctcctgcaacgtcaatgcgcaccggactacgtccccatacgatctgatccgaataaacattgagcttcggatagttcttttttccggcaacggcttccagtaatccgtcacggatatccctttcttctgcccgatccttatcatatcggaacactgtatatcccttagtccctcgtcgtcatggaaaccgttcacgtaccggaaaaggtgctgtttcacctcggccacgttcaacggccggctctgcgtgccacggatattccggataatggaaactgcactctccaccgattccagaaactcggccagcctgtcccggtctgccttcgccagtttctcgctatacgccaacgggttggcctggtacgctagcagctgtcagcaatgcggaagctgctttgagtacagcgcgtacaaatttaggatattgttatgttcgtgccccttttgacgggacaatcagcaagtcgacagtggatatcggcagttatgtcggtggttctttgcagccggttacgctggctactatttataaggacgatcagatgtatgcgtattttaatgttgctgataatcaatggctggagatgtcgatgaacaatcagcagccaacgaaggatcttctagcagctgtcagcaatgcggaagctgctttgagtacagcgcgtacaaatttaggatattgttatgttcgtgccccttttgacgggacaatcagcaagtcgacagtggatatcggcagttatgtcgggggttctttgcagccggttacgctggctactatttataaggacgatcagatgtatgcgtattttaatgttgctgataatcaatggctggagatgtcgatgaacaatcagcagccaacgaaggatcttctcaaagacgccaacttcgtcaacagcttgagtggcaaggtagcaggtgtcattatcaatagcagttcttccggtgtcggcggtgccagcaaagtagtgatgcgcggtacaaaatccatcgaaaagagtaataatgcactttatgtaatcgacggtatacctatgtataacttcggaggtggtggcagcacagaatttggttcaaaaggagagacggaaagtattgccgacctcaatccggatgacatcgaaagtctcaaagacgccaacttcgtcaacagcttgagtggcaaggtagcaggtgtcattatcaatagcagttcttccggtgtcggcggtgccagcaaagtagtgatgcgcggtacaaaatccatcgaaaagaggaataatgcactttatgtaatcgacggtatacctatgtataacttcggaggtggtggcagcacagaatttggttcaaaaggagagacggaaagtattgccgacctcaatccggatgacatcgaaagtctcaagatgacattgacggtagacgaaaacggcaaaccgttttataatgtgtcggtggatgactccctcttgatagaaaattcagccatgggctttacggcggctaacggcatcattctggcagaagggtttcaggtgaagaacacgactttcagcagtgaagacgaaacttggacacagccgtggggagagaataaaaagaaccggaatcattataacgaaatggcagtcagcctgacaaatgaagatcaggtactcaccgcactgaccttcttcaaattcttcggcacagtgggcgcaatcacctgagccttcggacgttcacgatcagaaaatttagtaccataaggcgttcgtgtaggagatgccgcacgtgtaaatccaccttcgatctccctgcggaaacgccccgcaccttcgtctaccgaccggctgactcccgcctcatgcggcaaccgcaaataattcacatcgatatcgcgcaagaaacggctgggacttccaaactccatcaccgcactgaccttcttcaaattcttcggcacagtgggcgcaatcacctgagccttcggacgttcacgatcagaaaatttagtaccataaggcgttcgtgtaggagatgccgcacgtgtaaatcccccttcgatctccctgcggaaacgccccgcaccttcgtctaccgaccggctgactcccgcctcatgcggcaaccgcaaataattcacatcgatatcgcgcaagaaacggctgggacttccaaactccatcagcttttgcgtgttgttatggcctttcggcgacttgataaccacctgtacgggcacggtcgttttccccgaatacagatccagcgactggtcggccgtcaagcaccattgttcccccagccggacagccgcgtatttcgcaataaaataccagaatgaggtgtaccagaccgtcgtgtccccctctgttcccggcctggccgcaatataccagcctttcattacttcctgcaaccagccgttatccaacagcctcctttattgaataggtgacaaagttatccttttcttcattgtaatagcagattccgccccggtcggtagaaaaccagacacgtcctttactgtcctgcataacggagctgactgagtttgaactcaacccatcgggttcattttccttgctttcatactttttataggagtcggtctgaggcgaatatctccacacgccacttcccatcgtggcaatccagacagaaccgtctttcccttcgcacagatcgaaatcctttattgaataggtgacaaagttatccttttcttcattgtaatagcagattccgccccggtcggtagaaaaccagacacgtcctttactgtcctgcataacggagctgactgagtttgaactcaccccatcgggttcattttccttgctttcatactttttataggagtcggtctgaggcgaatatctccacacgccacttcccatcgtggcaatccagacagaaccgtctttcccttcgcacagatcgaaatccgcagcgacaaggaggggatcttgtttaacgaacggctgtatcaaacaccgattcgaaaggacgtttgggacgcagataagaaacgcattccggcacgtaacatgattatcgtcgcatcgacgggggggggaaagtcggttacgtcgttgaacatcatccagcagaacatcgagcagaattataaacagatcgtcgtcgagttcggaaagagcttttaccagctttcgcagttgtacccggacaggtcgctgctccgtccggatcgggaacagcatctatgagatgcaaaagaccgtgtacgacagggacggactgcccggtatatatgtgcccttgaacatcaaggcggaagcgacaaaggaggcggccgacgaggtggctagcgatatgaacgttacctcttacgggacggacgttctaagtacgggggttaatgcggtgagcaatgcggcaaagagcgtgttccggaagaagaacaaccaggtcgttgtcaccgtgaagtcgaactctcaaccagcacggactcgccccgtgccagccttgtggtctggtcgtcggagagtcgtacccggttcacttcctgcggtatggtgatttcactgaccggaacatggtgcaggcggttggttttggggttgagcgagagcagacacggctcacgcactcctccggcaagttccagctcaacgacgcagccggcattgttgctcctggaaagattctctttcacttcgggagaaagctccgtacccatgtacggcctctcaaccagcacggactcgccccgtgccagccttgtggtctggtcgtcggagagtcgtacccggttcacttcctgcggtatggtgatttcactgaccggaacatggtgcaggcggttggttttgggattgagcgagagcagacacggctcacgcactcctccggcaagttccagctcaacgacgcagccggcattgttgctcctggaaagattctctttcacttcgggagaaagctccgtacccatgtacggcctcttcagatctggatgaaagacttgctccgcaacgggctgctgaatatcccggaaagagcacatacactatttgaacccatatcccgcaggatgattgatgcacaggccggcggattggcgggcaggttacgatcgctacaggaaatcaattactatacagacagttggaaatatgagcttaccgacaaattgagtaaactgtatcttctgacagaaagttataagaatctggattctctttctgctgagtggcatcttcagatctggatgaaagacttgctccgcaacgggctgctgaatatcccggaaagagcacatacactatttgaacccatatcccgcaggatgattgatgcacaggccggcggattggcgggcagggtacgatcgctacaggaaatcaattactatacagacagttggaaatatgagcttaccgacaaattgagtaaactgtatcttctgacagaaagttataagaatctggattctctttctgctgagtggcatcttcgagcgagatactgtcatctcccatgggcttccacttcggaatgctgcggaaagtgtagagcatgatacggctcggaagtcctttttccgaagtctctatcagtgaagccatctgactcggggtgccggtgaggaacatggcaagcatgggaaaacggatataaatgggggttaagccattgatcttgaaagcggaatcgatattttcatgctcgaatgccttgcggagcatatcgtcaaagttaccgcaatcttcgagcgagatactgtcatctcccatgggcttccacttcggaatgctgcggaaagtgtagagcatgatacggctcggaagtcctttttccgaagtctctatcagtgaagccatctgactcggggggccggtgaggaacatggcaagcatgggaaaacggatataaatgggggttaagccattgatcttgaaagcggaatcgatattttcatgctcgaatgccttgcggagcatatcgtcaaagttaccgcaatcttgcccgtcatgccaaaggggatgaatgtatctcccgcttgccatttgcggcagtgaatttcctcatttaatttgtctgcatcgaaacaggcggtttctttttcccgtggaatccggaaatcgggtgtgaattctctttcctcttttattaattgatagggaagggtagattcgtcttccggccggatggtttccagtagcagcaaattccggtctttaatgactctccattctttgctgacgaattgtttcctcttgcccgtcatgccaaaggggatgaatgtatctcccgcttgccatttgcggcagtgaatttcctcatttaatttgtctgcatcgaaacaggcggtttctttttcccgtggaatccggaaatcgggggtgaattctctttcctcttttattaattgatagggaagggtagattcgtcttccggccggatggtttccagtagcagcaaattccggtctttaatgactctccattctttgctgacgaattgtttcctctgaggaatgttataatcaatccatccttcacgtgcccaaagcaatacgtcggcataaagatcatcatagttctgcaaaccatttgtgttgctgcccaacggatctgttttctgattgcggtaaataccgaacgggctgataccgaacttcacccacggtttgatgccccgtatcgtttcatgaagtttcttgatcaggatatttacgttgccacgacgccagtccgccttattgctgaaaccgcctccgtaactctgaggaatgttataatcaatccatccttcacgtgcccaaagcaatacgtcggcataaagatcatcatagttctgcaaaccatttgtgttgctgcccaacggatctgttttctgattgcggtaaatcccgaacgggctgataccgaacttcacccacggtttgatgccccgtatcgtttcatgaagtttcttgatcaggatatttacgttgccacgacgccagtccgccttattgctgaaaccgcctccgtaactcgatgtaatccttgctgatatatcccttattgacagctttggcaagtgtatagataaataaggcggttgccgaagattccaggtaatttccttcacgcgctccctgatctgttacctgataccaggtgccggactgagggtcctgatatttcattaaagtttttgccaatccctgaagaatctgcattacgctgtctcgtccggtcgtttcctgagggagataatccagtacgtctaccaaggctgctccatactcgatgtaatccttgctgatatatcccttattgacagctttggcaagtgtatagataaataaggcggttgccgaagattccaggtaatttccttcacgcgctccctgatctgttacctgataccaggggccggactgagggtcctgatatttcattaaagtttttgccaatccctgaagaatctgcattacgctgtctcgtccggtcgtttcctgagggagataatccagtacgtctaccaaggctgctccatacttactatcttcattagcttttcgtgggtggtacggctgacatataacggttgtcggtcggtcaagtccacccgcatgaaataggtttcccggtaatcgcccggagtgttctttttccggcgggcaggttctttcaccgccttttcttccttaggttctgccttgatttcttccttattcactgtttccggcttatccggtgtttccactgttaccaatggtgtttcctgttttttcacgggcaagccctgtgaaattactatcttcattagcttttcgtgggtggtacggctgacatataacggttgtcggtcggtcaagtccacccgcatgaaataggtttcccggtaatcgcccggagtgttctttttccggcgggcagggtctttcaccgccttttcttccttaggttctgccttgatttcttccttattcactgtttccggcttatccggtgtttccactgttaccaatggtgtttcctgttttttcacgggcaagccctgtgaaagacgggacaaccggagaggcgcaccccgaaatagatgccatgctggaggcgaaaagctggttttgcccgatacgggagcagcaaggcgacagggctttctattctcctttagccgattatatcgtagggccgcttcgctcgcagttcgtcgatatgcagagcttttacgaaacgcttctgcatgaaatgggacattccacgggacaccccacccgattgaaccgggatcttgcgcacccgttcggatcagaggaattccacggaacaaaagatacattgatttgcggctgctacggagaacaacctttcttgttgtcaggccgtgtgcccaatgcaccgaaagtatgccgccgtgttacttgttctcatgaaatggactgggtacgcgcttgtaaggaagacaaatccaaccgcgtgatgccgaaagcggatttctccgaatcgggaccgatgaatgaaatggtggtaatgggtgtattggctatccgtctgcaaggattgaacaagacattccgcatctttcaccacattcacttcccgcagactatatatttgttcggagagcacaatattcttttccacatctccggcagatatggaaaaggagaatgtttgtccagcgaaacctaaagaagaaacctcacaggtatattgtcccgccgggagcgaggtctgaaaacagccgttatcatcggtggtgaagcctgttttaagttctttcagatagagtgccgcataggggatcggatttcctgcaagatcaacttccgcatctttcaccacattcacttcccgcagactatatatttgttcggagagcacaatattcttttccacatctccggcagatatggaaaaggagaatgtttgtccagcgaaacctaaagaagaaccctcacaggtatattgtcccgccgggagcgaggtctgaaaacagccgttatcatcggtggtgaagcctgttttaagttctttcagatagagtgccgcataggggatcggatttcctgcaagatcaacttcttcgtagaccaacgcgaaaaccgttcactgctggagcattattctaaagaccgttcggtactgaatatgttctgctacaccggcggtttctccttctacgctatgcgtggaggtgcaaagctgggacattccgttgacagttctgccaaagcaatcgatctgactaacaaaaacgtagaactgaatttccccggcgatgcgcgtcacgaagctttcgccgaagatgctttcaaataccttgaccgcatgggcttcgactggaccaagatttccaatcatgacaagcctgaaggcatgagggtcgtattttatccgaccgatgatgaaagcaacacgtggatatttgatttccccggaggagaggatggggaagtggagcgccccgagaatgattaccgggtaatttgcttcaactacgataccgacgggatggtttggaaagaaaacggcagttacacgctttttactgccgatacgcgtgatgttcggtcgccggataaccagacatttaaccagcctgtcgtcgagatcaaatgcgacgaagccggggggaagaacaacaagagcaaagttctgaaagaggctatcgccatgatgcggaaaaacttttcctttcgctgggtgcatcccaataaccaccagacggtggaaacgttcggggtggtgataacgacggtacacaacatcaaaggcacaaaccgggtagccctgacgctcaacccctgggcgatccctttcctgctctactacggtacgggtgtctttcttcaacaaggcgatcgcctcccggtattcctctttcctctgttcggccgttttccggcttcccggcttccgtcccagcctgccccctttctggatgtacaactcccgtccgctattaaggcggtcaatgatcccctggcgttcgattgcggccagttcccccaatagggtagtaatcagagaggacaaggggtttaccgtcttgtccggccgtaatgtttccaggttcaagttttggatatacacgcatattttttcggacgtgaggccggaagaatgggaagcgttaagggagaagttcagagggggacaggcagagcagcccgacgggacaaccggagaggcgcaccccgaaatagatgccatgctggaggcgaaaggctggttttgcccgatacgggagcagcaaggcgacagggctttctattctcctttagccgattatatcgtagtgccgcttcgctcgcagttcgtcgatatgcagagcttttacgaaacgcttctgcattgtcttcgtctccgcagtaaccgtccggtccgggcgtgtacattctgtccattacctgacgtaaccaatattgagccttccacggttgtcccgcatagtcatagaggtagatcatgtgctggatcggctgattaccatgtgcatagttgcccatattcatcactgtcatttcacgaatttcgtgaatcacttgtccgtaatagctgtcatcaaaaatgggcggtacggcaaatacggaatccatcatggtaacattgtcttcgtctccgcagtaaccgtccggtccgggcgtgtacattctgtccattacctgacgtaaccaatattgagccttccacggttgtcccgcatagtcatagaggtagatcatgtgctggatcgactgattaccatgtgcatagttgcccatattcatcactgtcatttcacgaatttcgtgaatcacttgtccgtaatagctgtcatcaaaaatgggcggtacggcaaatacggaatccatcatggtaacatgacggaagtaagcacggcagcggaacttctgaatggagaaaacgtattctggtacgaagaaacccccaatctgaataagtttgcaaccaaaggaagtgaatttgagaaagtggttatcacaaagaacccgctgttgcacatcaaactgggcagcaccgacatcaccgccaatcgtatcgagctggacgtggaaggtttccgctttgagccggccgaccggaacttggtaagcaacggaaccctgtctgcaccgctggaaggtttgcctgtgggcacgcctccttgatggtgaccatgcctacaaactgataaccgaccaattgactctggtacgtaacgaaaagaaaaaaggaggtacctaccctaacctgttcgatgctcgcccgcctttccagatcgacggaaacttcggttgtgctgcaggtatagtcgaaatgctgatgcaaagttacgatggctttatttacctgcttccggcacttccgactctctggaaggacggttctgtctggaaggtttgcctgtgggcacgcctccttgatggtgaccatgcctacaaactgataaccgaccaattgactctggtacgtaacgaaaagaaaaaaggaggtacctaccctaacctgttcgatgctcacccgcctttccagatcgacggaaacttcggttgtgctgcaggtatagtcgaaatgctgatgcaaagttacgatggctttatttacctgcttccggcacttccgactctctggaaggacggttctgtcccgataagcggtgaaaggcagtttcacgcaggcctggatatggcggcggtgtatgcggctaccgtacacgccgcagccagtgggacggtgacgttcgcaggtgaaacgcccggatatgggaaaacggtagtcgttacgcaccgtttcggatttcagaccagatacgcacatctgacactcatttacacccggaaaggtgcgaaggtggaaaagggggacgtgatcgggttcgtgggaagcaccgggataagtaccgaaataccatttctgccacttcaagctgcccaagcagaaggagacaacaccgaaagcactcagccgtgagaatttcgagaagctgcgtgatctggagataccggaaaaacgcaggtcacatgtcatcccccgggacctcttcctcttcgcctgttacaccggcaccgcctatgccgatgcggtaagcatcacccggaagaacctcttccgggatgacgagggcagcctctggctgaaataccagcgaaagaaaacgaaccgttcgtttcggggtctgtgtccttcagttgcttgtctttcacaaagatgaacggattgtaggccgtagcgtagatgcggcatttctccatcaataccttgcgggaaatgttggcggggagggtatatcccaaagtgatattcttgatcttgatgaaggagccgtcgtgtactctcagcgaaggatataccgttttttgttcgtctcccgttccgggacgcgggaagtatgcgccctgattgtcctctgtcgactttcccccacccgtcgatgcgacgataatcatgttacgtgccggaatgcgtttcttatctgcgtcccaaacgtcctttcgaatcggtgtttgatacagccgttcgttaaacaagatcccctcctggtcgctgcggaacgtagagtaattgatccccatgcagagcgacgaatgcagatccgaaagaaacaggtagtccggattcaggttgttttcccggccgatgatcgagcctataaagatattataaagcgatatccacacactggaagaagcgatcaaaggcgccgacgtattcctcggcttgtccaaaggtaacgtactgagtcaggacatggtgcgcagcatggctcccatgccgatcgtattcgcactggcaaacccgacaccggaaatctcttacgaagatgcaatgagcgcccgccccgacgtactgatggcaaccggacgttccgactatccgaaccagatcaacaacgtaatcggcttcccgtacatcttccgcggcgatatccacacactggaagaagcgatcaaaggcgccgacgtattcctcggcttgtccaaaggtaacgtactgagtcaggacatggtgcgcagcatggctcccatgccgatcgtattcgcactggcaaccccgacaccggaaatctcttacgaagatgcaatgagcgcccgccccgacgtactgatggcaaccggacgttccgactatccgaaccagatcaacaacgtaatcggcttcccgtacatcttccgcggcgatccgaagtacagttgttgcaatgtaccatggctacgaggcttccgtcgggagtggtgaccatgtcgatcatttcgtatggcttcgacaattctttttccaatacgatcatagagaaagaagaagtccctgccgatacgttgccggtgcgttgcttgacggcgttggttgctaccatgccggtgcctgcgtctccttccggtgggcagaccggtattcctgccttcagatgaccggatgcatcgagttttttacgatctcctttccgtttttgtaaacggtcactacccactgcatcggctcgttcacaacgccgtcctctccgtccacgacaccaccggaaacggcaaactcgatcgcctttcccgtcgtgcttaacgtccccttttcgacggccagttcttcatcgcttagaatcaccgggcttgcgaggctttcccccgtcgccccgtctttcaactgcgtaccgttggcgactaccacgaccgacttaatgaagctgcggaaatcgatgcccggatacttgcgtgaagaaggtttgatttcttctacattcagtttttccagcatcttcttgcggcttgtggtctgcttgctcttcgctacgttggcactgaaacggcggataaattcttccagttctttcttcttctcctcagccttcgccttctggttctgctgctgacggagcgccagctgactagattcgtaccagaaactgtagtttccggcaaacatattgatctttccgtagtcgatgtctacgatgcccggatacttgcgtgaagaaggtttgatttcttctacattcagtttttccagcatcttcttgcggcttgtggtctgcttgctcttcgctacgttggcactgaaacggcggataaattcttcccgttctttcttcttctcctcagccttcgccttctggttctgctgctgacggagcgccagctgactagattcgtaccagaaactgtagtttccggcaaacatattgatctttccgtagtcgatgtctacgagcttaaaaggatattgcaggacgagcagtttacggcggcaaaccagatcgtcgcagccatgagggaacaaggttacacgcaccaggtaaggaagggggtgcattccttttcacgggagggtgaagggttccaggttgaacacaggctcttgaaagcgttcgaacaacctctgtctgacgagcagctaaaaagcataacggaacgtttcgacttgacaaagtacgaggcgaacccggccgggtacagggagaacgcatgcttccgaaaaggtgaaatacgaaatataccgtgcggtcaaggaagctttgaggagtgcagatacatggaaagaatttcaaaataagctcttaaaaatgggcgtggaaatggaattcaagtacgaggaaaacactaatgaagtgcagggcatccgctttataaagaacggtctgtcattcaagggaagtgggattgaccgcagtttcagctggtcaaggctggatgcggcattggaccataaccatgtcacgcatgcttccgaaaaggtgaaatacgaaatataccgtgcggtcaaggaagctttgaggagtgcagatacatggaaagaatttcaaaataagctcttaaaaatgggcgtggaaatggaattcaagtacaaggaaaacactaatgaagtgcagggcatccgctttataaagaacggtctgtcattcaagggaagtgggattgaccgcagtttcagctggtcaaggctggatgcggcattggaccataaccatgtcacgccatcgccagcgaaaagaaataattcgtcgccgtttccgaaaccttttccacattataaagaaattcctttttcacacgctcgtatttcagcggttcgatcttccggtcccatttgaaaggattatacccgaccaggctctgcgaataaccgagccgtatcgggacgctggtaaactgtgtcgcactattatccccgaaattacgcatataggcaaggttcgactccagatagaacgtacctccggtcaggtccgccatcgccagcgaaaagaaataattcgtcgccgtttccgaaaccttttccacattataaagaaattcctttttcacacgctcgtatttcagcggttcgatcttccggtcccatttgaaaggattatccccgaccaggctctgcgaataaccgagccgtatcgggacgctggtaaactgtgtcgcactattatccccgaaattacgcatataggcaaggttcgactccagatagaacgtacctccggtcaggtccgccctcactcctgtgatagaactaatgcgcattcggagtttatcaagacttgataggcggtgaagccctcgcatcttatcagtcgctctacctcacattagtaactcacaaggctgcacctaaatgcctttcggggagtacgagctatctccaagtttgattagcctttcacccccaccctcagttcatccggaagcttttcaacgcttatcggttcggtcctccagttagtgttacctaaccttcaacctgaccgcggggtttttactgggggcttctgacctttgcactgtttcctattgttccgtaaaatcagtgtcgcacagtccgcaccttaacaccagcccggattttccccacacgttacagccgcacccacaggcgtatttcttccgctttccgcttttgctctccccctcgtccggatcttccggttcttccgtttcgtccccgtcgcttccggcgatgcggatcggccgggtaggtacggccgccaaagtcggcttgtacgtactgggattaacaatacaacaactttggcagtaagtggtgcttccgataagatatcctatcgttttggtgtttccaatatggcggtaaaggggatacttcccaattccagcatcagtcagcaaggtatcaatatgaatacgacttatgacatttcttcaaaagttcatttaatggtgaatgccaactacgtattcgacaagaataaaggtcgttctaacttgtccgatggtaacagtaacacgaatgccgcacgtactgggattaacaatacaacaactttggcagtaagtggtgcttccgataagatatcctatcgttttggtgtttccaatatggcggtaaaggggatacttcccaattccagcatcagtcagcaagggatcaatatgaatacgacttatgacatttcttcaaaagttcatttaatggtgaatgccaactacgtattcgacaagaataaaggtcgttctaacttgtccgatggtaacagtaacacgaatgccgcacgttcgacttcacggtgacaacgacctggttgttcttcttccggaacacgctctttgccgcattgctcaccgcattaacccccgtacttagaacgtccgtcccgtaagaggtaacgttcatatcgctaaccacctcgtcggccgcctcctttgtcgcttccgccttgatgttcaagggcacatatataccgggcagtccgtccctgtcgtacacggtcttttgcatctcatagatgctgttcccgatccggacggaggtacgatgagaatgaccggaaaatttgtgttgctgcttgcggctatgcttgccctgtttctggggcaggcgcaggcccaacgctgcctgccgggtatgaaaggtgtgcagctaatggcggatatgggtgacggtttttattgcgggaaggaacgtaatgatacgggattcgctttcggacttgccgtttctacctatgctaagggaggaaataaatgggcatcgggtattgaaatcatgcggcggtattatcccatcaggtattaacccaaagtacttaatagtgttgtacttaaaacgtacggttcgatatatacttttagctctttactaaattttactttttgtacatcatgtcaaagatcgtttctcttttcagagatggtggagaataacggattcgaaccgttgaccctctgcgtgcaaggcagatgctctagccagctgagctaatcccccaagagtaattgaacattgcaataatgaattgacaacgacaatttttgttcggggcacaagagtcactgttaataacctgccggtttttcgacggcggtaagtcattacattcccatcgatatcatgctttttcagataggcaagatccacaaaaggaatcccacgaagtaaaaacattaaaaagaaaagaccacgagtacgctgtagttccttgttgtcctgacacagctgtttcggaagttccttcatcagacgctccatgtcttccttatccagcgcacgtttcctgtccgcgcgcgttcctgtatacatccggtaaggctaaatactcccgagagaccgatagcgaaccagtactgtgaaggaaaggtgaaaagcacttcgaatagaagagtgaaatagtccctgaaaccgtgcgcctacaagcggtcggagctgcttaagcagtgacggcgtgccttttgcataatgaacctacgagttactttttccggcaaggttaagcatcttgagatgtgcagccgaagcgaaagcgagtctgaacagggcgtcgagtcggaaggagtagacgcgcctgcatgttatcgtattgggtctttgctttgaatacgacctgtgacagaatatgtttgaaattaaatttcactattccgttgttcatgtcttttgtctggcctttggccatggcatacatcacgtcgtagtttgcatgagtagtaccgcttccatactcatccatgcaggtataacttatcttttggacatccttggtggcttcccaactataaaacgccatcatgtcttcactaaccgttccgggattgaacgcgtaaaagtccaaaaggaatttcgctaccttaggaccgttatagttacggccgccgtttactggggcttcaattcaatgcttctcttgcgatgacatctcctcttaaccttccagcaccgggcaggtgtcaggctgtatacgtaatctttcaatttggcacagccctgtgtttttgttaaacagttgcctggacctattctctgcgcccaactctcgttgggaccctttatcccgaagttacagggtcaatttgcctagttccttaaccgtgaatcactcaagctttcggggagtacgagctatctccaagtttgattagcctttcacccccaccctcagttcatccggaagcttttcaacgcttatcggttcggtcctccagttagtgttacctaaccttcaacctgaccaagggtagatcacttggtttcgcgtctactccttccgactcgacgccctgttcagactcgctttcgcttcggctgcacatctcaagatgcttaaccttgccggaaaaagtaactcgtaggttcattatgcaaaaggcacgccgtcaccctggggagtacgccggcaacggtgaaactcaaaggaattgacgggggcccgcacaagcggaggaacatgtggtttaattcgatgatacgcgaggaaccttacccgggcttaaattgcatttgaatatattggaaacagtatagccgtaaggcaaatgtgaaggtgctgcatggttgtcgtcagctcgtgccgtgaggtgtcggcttaagtgccataacgagcgcaacccttatctttagttactaacaggtcatgctgaggactctagagagaccctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaaggtgctgcatggttgtcgtcagctcgtgccgtgaggtgtcggcttaagtgccataacgagcgcaacccttatctttagttactaacaggtcatgctgaggactctagagagaccgatctccaggatcttgtgcgtattgcatccgacggccggagttcctttctcctgccgggctatttcgagatccgtttgcagtttcccggccttctcccggttttccctggcttcctgttccagttgcttggaacgctccaaaagttcctgtacctgtgagatgtgcatatattcgtccggattgtcccccggcgttttcacttccccgacaagcgacaaaaggagttgttcgatgtttttcagccttacgttagtggatttctcaatgccccggacaacttcgatccctgtagctagcgttcatcctgagccaggatcaaactcttcattgtaaaagtattgttagtcagcataaagctgatttttgctctgttcaggatgccgtacaatttattgacttcattaataccttacgtctcatgcatattactatatatataagacaagtattgacggttctatttttttcttgtactacttgtattgtttatcaatatttcaaagaacatcttgctttcgttttaaaagcgggtgcaaaggtaagaggttttattttaactaccaaatgttttcggaagttttttcactgttacgcagtaccatcggcgtgacgaggcttaacttctctgttcggaatgggaagaggtggaaccctcgtgctataaccacctgaataaattcaataaggttatgacatgatgaaaagtaaaacttaagtaagatatcagagtcaaatgaatgaacttactgatacgctcgctaaacgtatatatcgcgatccgcaccgtccgaaagaaagtgaacgggcaattagtaatgctcggctttgatgttaccacctttacacctgcatcctatcaacgtcatcgtctttaacgaccctaaactaagttgaactaacgaagtcagattgctaagacagctaggatgttggcttggaagcagccattcatttaaagagtgcgtaacagctcactagtcgaggagtttggcgtggataataatcgggcattaagtgttttaccgaagctatgggatcagtaatgatcggtaggggagcattccactctgcgtcgaaggtgaagcgtgagctttgctggagcgtgtggaaaagcaaatgtaggtataagtaacgataaagggggtgagaaaccccctcgccgaaagactaaggtttcctgatcaacgctaatcggaactaagttgaactaacgaagtcagattgctaagacagctaggatgttggcttggaagcagccattcatttaaagagtgcgtaacagctcactagtcgaggagtttggcgtggataataatcgggcatcaagtgttttaccgaagctatgggatcagtaatgatcggtaggggagcattccactcagcgtcgaaggtgaagcgtgagctttgctggagcgtgtggaaaagcaaatgtaggtataagtaacgataaagggggtgagaaaccccctcgccgaaagactaaggtttcctgatcaacgctaatcggaaagtctccggcctatcctacacatcaattacccaaattcaatgttaagctatagtaaaggttcacggggtcttttcgtcccatcgcgggtaatcggcatcttcaccgatactacaatttcactgagctcacggttgagacagtgtccagatcattacaccattcgtgcaggtcggaacttacccgacaaggaatttcgctaccttaggaccgttatagttacggccgccgtttactggggcttcaattcaatgcttctcttgcgatgacatctcctcttaaccttccagcaccgggcaggtgtcaggctgtatacaaccccctcgccgaaagactaaggtttcctgatcaacgctaatcggatcagggttagtcgggtcctaaggctcagccgaacggtgaggccgatggcagaacaggttaatattcctgtactaccttaaggagtgacgtggagacggagcagtgacagcgccgcggactgacggaatagtccgttgaagggtgtagatgttgatcatcccaggcaaatccgggatgagagtcgaacctgatagtatggagcgttcttcggaacaatccaatagtgcgtgtaagcatactcccaagaaaatccgctaaacttaatccttatgcccgattattatccacgccaaactcctcgactagtgagctgttacgcactctttaaatgaatggctgcttccaagccaacatcctagctgtcttagcaatctgacttcgttagttcaacttagtgtttatttggggaccttagctgatggtctggattcttctcctttaggacatggaccttagcacccatgccctcactcctgtgatagaactaatgcgcattcggagtttatcaagacttgataggcggtgaagccctcgcatcttatcagtcgctctacctcacattagtaactcacaaggctgcacctaaatgcagcatctaagtacgaagccagccacaagattagatttcttagggtcgttaaagacgatgacgttgataggatgcaggtgtaaaggtggtaacatcaaagccgagcattactaattgcccgttcacttcctttcgactttgtacgggttggatatatacgtttagcgagcgtatcagtaagttcattaaattggatctgatatcttacttaaattttacttttcatcatgtcataaccttattgaatttattcaggtggttatagcacgagggttccacctcttcccattccgaacagagaagttaagcctcgtcacgccgatggtactgcgtaacagtgcccccggcataaattccgaacacacgtgcaggaagctgtctatatcgaagtattccggcaggatattcaaacgctcatacagttttttcccctctctttggacgtacctgtaaaagtccgggaaacaatggccgtcgggaatatcctcgtaataacggcaaatgatctttgtcagcgaaacaacttgtttcgtgtcctccatgatcgccttagaccgccagaatttaagcaccaggtttacaagcgtctttatcttctcgttgtccggctgcttcccggccgtatagaacggattgatccccaacgggctgctgccgtcataatcaatatgcagcgacctgtccgggaactgacttaactgtccacctacgctccctttaaacccaataaatccggataacgctcggatcctccgtattaccgcggctgctggcacggagttagccgatccttattcatatggtacatacaaaattccacacgtggaaaactttattcccatataaaagaagtttacaacccatagggcagtcatccttcacgctacttggctggttcaggcctgcgcccattgaccaatattcctcactgctgcctcccgtaggagtttggaccgtgtctcagttccaatgtgggggaccttcctctcagaacccctatccatcgaaggtttggtgagccgttacctcaccaacagtagtcccaggcagagttgaactgccgacctctacattatcagtgtagcgctctaaccaactgagctataggactagttcaaccttgtctacctgatgttagactcggcttctttctttctcttgtttatctctatctatacttctatagatggttgatctatatattataaataaacaagtaccagtagtacaataatagaacctatgaaatcgttgtaacgacatcgctccagaaaggaggtgttccagccgcaccttccggtacggctaccttgttacgacttagccccaattaccagttttaccctaggacgctccttgcggttacgtacttcaggtaccccctgttcggagtagtcccaggcagagttgaactgccgacctctacattatcagtgtagcgctctaaccaactgagctataggactagttcaaccttgtctacctgatgttagactcggcttctttcttttctcttgtttatctctatctatacttctatagatggttgatctatatgttataaataaacaagtaccagtagtacaataatagaacctatgaaatcgttgttacgacatcgctccagaaaggaggtgttccagccgcaccttccggtacggctaccttgttacgacttagccccaattaccagttttaccctaggacgctccttgcggttacgtacttcaggtacccccagtcgttacgcaccgtttcggatttcagaccagatacgcacatctgacactcatttacacccggaaaggtgcgaaggtggaaaagggggacgtgatcgggttcgtgggaagcaccgggataagtaccgggaatcatttgcattatgaggtgataaaaaaccaaaagagaataaaccctttaaatttcatttatggaactaagtaatgaattgaaagtagaaaggatcaggctaagcctgacggcgaaaagcgttgccgaggaaatggggatcagccgccagcagctttgcaacatcgagcagtcggaaaccgcccccgtggtggtgaaatacatcgcttttctaaggagcaaaggggatatacatatacagcatcttcaatgcgcttgcttacttgctcgaagctctcatcatcacagtcgaatagccaaccgtttttaatggtgttgttcattctttcagccaatgcattatgtaaaggatcaccacactgcgtcatactgatgttgatttgatgctctttaagcctctctacatatttatttgagcaatattggacaccccggtcggaatgatgaataagagtgctcatgtctatgtgatacttctcatagaatgatattgccatctccaaagctttcaagggcccctccgtctcaagagttttgtaaagcgcatatcccacgatggcacgacttgacgcatcggtaagcaacgagaggtaagcccagccctgacctattataaaggaactgatattttagttgatgcagttaacttattgcctgctgaatatagtgaaaagattgaaactagaatagttggtggtgtcggtgaaagctatttacaggaacttaaaggtaaagattctaactcccttattcattggaaatcttactttttgtctaatgatgaactttatgaagagataaataatagtgacgttttagtccttccttatagagaaatatcacaaagtggcgttctgttgttatctatttattttgaaaaaaatataatctgttcggacttaccttcttttgtagaaacgattcatggtgatcaggacaattcgttggatcatgattttttcttcaaaaataatgatccgtcttctcctccagaaaggaggtgttccagccgcaccttccggtacggctaccttgttacgacttagccccaattaccagttttaccctaggacgctccttgcggttacgtacttcaggtacccccggctttcatggcttgacgggcggtgtgtacaaggcccgggaacgtattcaccgcgccatggctgatgcgcgattactagcgaatccagcttcacgaagtcgggttgcagacttcgatccgaactgagagaggcttttgggattagcatcctgtcaccaggtagctgccttctgtaccccccattgtaacacgtgtgtagccccggacgtaagggccgtgctgatttgacgtcatccccaccttcctcacatcttacgacggcagtctctcttgtaagtgagaaccggaagtaaattcgataacattgataatatagacgaaaaatgagtaataataagtacaatataataacagattgcaagcgtttccacttcggatagtgcttgccggatagtctgatacaagctaaaggctgcgattctttatgggaattgcagccctttttgttgcttaaaattgatatttgttgctgaaataacgatgctcgggtttataataaacttgggggacgtttataataaacgatgaacgaatttattaataaatgattcggaggaagtatataaagggttaatatatttcgtgtgaaagtgtgtaatgataccaagaaactttctgtttttattattaatgggtagtttgtctttacattctcttttttcattcttcgccgcccttgcacacatccaaaaactaccttaagaagcatttgtaaatccaaaaagaaaaaattatatttgttgtgatttaaaagaaatagaaaccagacagagtttaaattacactcccgcctaaacgtcgaaatgtttttgtttcttttttatcatcattttaaatctactttgttctgttattaattttttccctaaatgggcatggggtacctatgcctgcactgattcttcacagttattagtttattatttctgtggcataggtaatatagttgtcgtagtaggaatgctattgttgtttgcttggaagagaattggtttttggatattgttaaccgcttgtatactagcttcttttgcatctattgcaatggagtctattcccctgccggtacagatccaggctcttagtcagtatgtccctggattcccccagcacttgaaactgttcgtatgcctgtttaagttctttcgcccaggttatctgcgatagctgcgtcaaggccggatcggacaccacccactggccgaacgccgtacagtaaaagcacatcatcacaagcaaactacatagacatttccgtttcataacttttctgttttaattgtttatacttctctatggccgtttccatgcttccggcctccttgtaaatctcctgcaatttgttccatttctcgccgtcggtctggaatgcaagcaatttttccggtgaaagctccaggcgtaccaccgttgcataactatccataaaccggatgaatatctccgaatacggccgtagcatcctgtcaccaggtagctgccttctgtaccccccattgtaacacgtgtgtagccccggacgtaagggccgtgctgatttgacgtcatccccaccttcctcacatcttacgacggcagtctctccagagtcctcagcatgacctgttagtaactgaagataagggttgcgctcgttatggcacttaagccgacacctcacggcacgagctgacgacaaccatgcagcaccttcacaaatgccttgcggctaacctgtttccagattattcatttgcaatttaagcccgggtaaggttcctcgcgtatcatcgaattaaaccacatgttcctccgcttgtgcgggcccccgtcaattcctttgagtttcaccgttgccggcgtactccccaggtggaatacatgtgttactgtctaatttgaatttgttagaagatactatgtatactcagctatatctaggaacggggaagggtacttctatcagggaattgtcatacattatagagactgtgtataaacaaaaggttaatgcaaattggggtggattgtcatatagaccatacgatattatgtatgcagtggcacctatatctaggaatcttgatttattaaaatggaaaacaaaaataagtcttgaagaaggcataaaaatgttacgatacgaataattatagaattggcttagaactcagaatgaaaatagcttgtgtagtattaacttataatagattatctcttttaaaaagatgtattgatagtattcgtaatcaaacatatcaagagtttgatatatatgttattgacgaaattcgaacgatagaaatcgccaagaagttcaagctgataaggactaaaggtcatgtcactctttttcatcttttattcattttagttgatacttatagtagtcaaccaaatccagggtaagacaatgaaaggtagaaaagatacaaatataagcaggatatcatagaaaagacagtcagataaaacactaacaaccgcccaatgacaaggaatacaatatagttcaaaatacaatatccgcatgggttcggattgaattatcctaaaatttacatctaatctgaataccagagacaaaaaagttcaaagtatgctatgatattagcatataattgataaatttgcaagcaaaatatcttactttataacacataatctaatattactattatgacacagcacttcacttcttgtgtttgcataccaatatacgaaatctgcaaagtctttgcagaacttggtacgttcgccaaattaaaattaccatcgatgtctgtgattgtaccttgagtagtaccttttaccaacacagaggctccaacaactggttgcccatcttcttcagaaatcacaacgcctgtgactttctgagtctgagcagttactaggcttatgcccacaaaaaggcatgccaataacagcattaattttcttttcataaattctctcttaaagttcaactttacattaattgtctctatactctaacaagttgcaaaattattaataaatatgaaactaacaattaatttgataaaaaaaggttgtatatataacatattgttatttataacatcgaaaatatgctgataaacatctatttcttcataatatatattattaagggcatcttccccttctatcaattcatgaagtactgttttctcaaggtatccttcctgatattcccgttcgatttgctgatgcttgaagatattcagaataatgtttctggtcattataaagaggtagttatctaattcattttcattgtcaagccatatttccggttgtaaccaaagcttacagaaaatatcttgagcaacatcttcagcatcaacttccgacttaagcaacagctgggcataattctttactttcggaaaattagaaataaaaaaacgctgaaacttcagctcaatttggttaacattattttccatatccgctaagattattatcgattacaagtataaaaatagacattctcaaagattagaacataataaagatacgttacaagtagataatgatattaatatgagtttagggtaatccttcagtgtagttgttggtgaaaggagagaggatatggaagctaaagctacgctttacaaggtataaagctatgcttttcactccctaaagcatagccttatgtcttgtaaaacgcagtgttttatattggacttaccatagcgggagtagtcgatacaagaggtagtggaaagtggagatttataaaattgaagctgtctgataaaaagctgattgatataggaaagtgaaatctgtaataccaaaaataaagaaggtgaattctaagtcctctccaaacaatatctataaaatcttacccaagtttacgaacattaacgtatccttgggtaagtttgtatatagacatacctactcttcagaagtgtatagctacactcacacaaagcatatcccgagacattgtctttaagcaattccgcaggataaatcatttgtccggctacatattcccgtacacaaacatcagccaagcagggtaattcttcaatttgctttcccgattgcgttttgagcttcggaccaacagaataaatccccacatacatcggctttttgtgagcgtccggctgttctttggtacggtgctccagctctttcaataaagcggttgcttcctccgccaatgcttgttccgaaatattttctccctgagaaaacatgtaagtcgactgacaacccaacacaagccgctccatcaaagtacctttcatgggtgaccacttccgtcccatcatctcttttcctttcgcatctgtcgatgagaagtaataaacaactccatccagtccggctgtcgaaccgtccccggagtaccttttatcctttgagcgatgtcccttccatacggaaacaccggatcactatgctctagtttcctacctgatcgacttgtaagtctcccagtcaagcgcccttatgccattacactctgcggacggttaccaatcgtcctgagggcacctttagaagcctccgttactattttggaggcgaccaccccagtcaaactacccaccaaacagtgtcctcgtaccacgagttagaactcaaataatcaaagggccgtatttcaacagcgactccacaaatactggcgtacctgcttcgaagtctccggcctatcctacacatcaattacccaaattcaatgttaagctatagtaaaggttcacggggtcttttcgtcccatcgcgggtaatcggcatcttcaccgatactacaatttcactgagcccccgccatagagccgccagtagttatggtgccggtcgcttttccaccaggcatacatccaattcccggccaaggaccagttctttccgacgtaaaactccacccctatattcggcacaagcaacgcatcataaagcatgttcgttttcacggccatgtaaaaaggcccatgtttttccccagactggaaaccgcccgtttctccaccgaacggagaaagcttacaaggtaagtacaatgtatcatgcaggtgggagataacctgcatggcagggaacgacttccgtttcgattcataccaaatatacaaacaagatgcacgaagatccggaaacaaattccgatacatgtaccgatatgggatgccgtaccgcaagcgtttcaattcatttatcttgttctccccgtttccacttgcttccacctcggaaacaattaactacaattgtctttctttgataatgattgttgttggtaattatcgcagacatactgcgcggtaatctaagtaaacaaaatcttagaactgctataggggctataaaccgggtgcctgtttaattcactcaagtctctcttttttcgaaaaaagaggaattaaatctgagcagttttgattttggatacatatattgtggcagttttgatattcgtattttggttttccgatctattggttttagagaaatacatgttaaatgtagttcgaaaaatagaacattaagaaggtaggaaacatgcaaacgatttagaaaaactatgtatttttgtgttataactttcaaaacagtataagaagctttactcattttaatgcagaattgacttgtttgcgagtttaagcacaaatagttatttttattatattgacgaaaagctcaacctggcactgtagatattccttttggacaagctgtaaccataggattggatggctcagtaacaaaatgatgtctaagggatatgtgcctttatttatatcgaaaggttattaattaaaacttgtaatattatgaaatcattattttttaaaagtatactcttagtggtattcttggctgttgcagttcttgcaaatgcacaaattaagtattattcgaatggtaaattaactattggcaataccgaaccttattcattttatcatacgacgtttagtggaaacggaatatatatgaaatgtaatgctagtaacttctttcaaattgattgtagcccggctgcaactcgattggctagtcattatgatcaagttgttttctataatacagcatccggagtatataatagtattcaggtgaaaaatgtatataactctatatacattattatatagctatatcattaaaaaaagatagtgacactatcctgttacgatagtgacaccatccaacaaagatactgtcactataataacagcatagtgtcaccaagtattcgataaattagaagctataaatcaatgctaaacaaaagaaatatgataaaccgaaaacaatttctcattaaaagaattttcatttcagctgaacaataaatataagttattaatcaaatatcaccaaccttagaactaccaatcaacagaatcccaatcggcagcagaataccattccacaaattgacgataatatttctcctggctagaattattttcacgcaatatataagtagagactccttcaaatccatccatagaaaccatcttaccatagcccgatgaatatgtacaataattattatctgtagtatctttccctggaaaaaaacaacctggtgacgttccggccggatgcgaccgggcaggcggtgatcgagtttaccgtttcaagccgttacggtctgccagtgaaagagaatgtaacgatacaagtaaatcaatgaggttatgagaaaaattgccgtattatcgctctttttgtgcctggtggccgtgtgcagggcacaatatatcggaagccagtatatgaacgtgaagctgggctatatcgtggatgaaagtcaggtgcaggggacgttcggttttggaaaggtgtacaaggctttcaaggtgggggcaaaccttaattaccggaatctaaaccgggatctggtaaaggcaaacaccgtgacggtcggcccggagctggcctattacgccctgaaaggacggaaattctcgctcctggggatcgcagccgggacgatcggctaccagaaagccctccatctcttttcaattgtgttacaaaaataaagaaataactattaaccgcaacattttttttgatttttatttataataaagttaccttttttcctttaataatgtcttcaaaatctattctaattattaatttcaactaagttctgttagaactttgtttcttttcctatctacacatcttgcttttactttttcccagatctgttcttttattttaaaatctatagctttattttctgattcattccattgtattttaagttctctatccactgattccaggtcagcatagctccttcgctgctttttagtcagctgtcctgccagcaaacctttaatcaaactcatctttgtatctttatccatcctatcttactttgttattattctatttattattactcgtatattataaatacacttgagttaagtctatccccacatcactttagatataatacctttgtaaatagcaatagcctttaatggaatattttttcctacaatataatcagttggaatatcaccaaatccaacaaagcttataacaccattatttatcgcacttcgagcaagacttttagtgtcgttcctattggagagacaagaaagactaaaaaaaattttacctttaaactttgaaatattatctgaatgaataaaatgttcatttctgtaaaattcgggattctcaatcacagcatcttctgctataaaatcttgagattttttattgcaagaaccaaataaacaatcacttcgcccatgtcccatgaacaaaataaactttgcattactgtctatggccttttttatacaagactcatgatccgcattagaatattttatcttatagcaatgccattgattgtcaagctttctgcaaagataagtgtttattccgtcgatatgagctcttgggagggatcagcctgttatccccggagtaccttttatcctttgagcgatgtcccttccatacggaaacaccggatcactatgctctagtttcctacctgatcgacttgttagtctcccagtcaagcgcccttatgccattacactctacggacggttaccaatcgtcctgagggcacctttagaagcctccgttactattttggaggcgaccaccccagtcaaactacccaccaaacagtgtcctcgcaactacgagttagaactcaaataatcaaagggccgtatttcaacagcgactccacaaatactggcgtacctgcttcaaagtctccggcctatcctacacatcaattacccaaattcaatgttaagctatagtaaaggttcacggggtcttttcgtcccatcgcgggtaatcggcatcttcaccgatactacaatttcaaggcgaaaagcgatcttgtgtacctggagaaaagcaaggctttcgtgtatgggtacgaggtcgggataaggccggaaatgttgctaagcccgaaagtggctctttttgccgaatacaggtttgaaatgttgtttaactccattctccggaataacaaccatgtcggtctggggtgcgtgatctatttataaacttaaataattgaaggtatgagaaagtatttgtatttgtcagccgtatgcgtgtgcatggcattgtgtttcgtcggttgcagcaaggacgacgacgaaccgggaggaaaaggggcgatgtatgaggtaacgatcgagcagtcgggagatttccgcagcttcattaagtcggtcgtggtagtcgccaacggtacgcagttgaaagacggggcgacgggggaaagcctcgcaagcccggtgattctaagcgatgaagaactggccgtcgaaaaggcattctatttaaattaatgaaacaattcaattacttactttcccttattgtcattattaaaaatgttattgtcagcattacactcatttgtaaaattatacttaaatacatctagtctgaactataactaaattactcctctattttcttgataaaaaaataattgaaagcataaggaaaatcttctttttacaacacaaatacaacatcgatcgatgtaatatgcttgtttatagaagattagatcaagggtgtacggtttggacaggacccggagaaccaattatgcacggatgacttcgccggtcattgggcccataatgccaatctttcagtaaaagcgatcatgggtgtagccggatatagcgaaatggcgcatatgcttggtttatatgatgttgcagagaaatatgcaggtatagccaagaaaatggcggtgaaatgggaagaaatggcaaatgaaggttcttccagtgactttcctgtggtctccggcacgagtttccatacgatgagcatatacggcacgcacatgactgcgaacaggaagaatgttccggcgggggtgagattctggagcatccagggggttaactgtccgatcaggtacgttcctatccacagggcgaatcctgcaatggacatcgccagcccgcgtaccttggtggggtacatctccgaaaggagcacgaacaccacggcacagatggagacggcacagcagaatacatagaacaggaagaaaacaagcaggaagaggctggatactccccaggaatcaccgaagaggaagtaaacgccgatcagcaggagggagacaaccatacccgaaactccgtaatagaccagtttcttgcggccgaccctgtcaatgatcacaagagcaagaacggtggtcagagtgttgactagtcctacgagaacttggtaaaattcctaataagataaacaaccctaaagctttaacaaatcatctttctaaattaacagtaggaggtattatagatatacagaaccatcctctgaaaattgacatgaaaaaagtatctacggcaattttaaagaatgcgtatattatactttttgctcgttttggatattcttttcttttaaatagcttctatgataggataagagaacaaatattaaatccagcaaagcatattattcctgaaagtctgtggacaaaacaaacttctattagcgtaaaagatggtatctacttttcaaatagcaatgtgtacagaggtttttttataatttattcattgactaaacttagaacacaccatttttgtatttgtattcctacaccacaagtgtattttgaagccatagcgtattactttagagaatacaaggcaggtatacctatatatatgatggggtctgatggtatagattattttcaacctactgtcctttcaggctcttccttcttcggcgtttcctttttcggccgggctttcgccgttctccgtttcatggctgcggccgctttcagactgtcggctctctggttctgccttaactgttcctgcaaggctatcacttccggatcttcccggtacatagctcccgaacgttcccggtacacttcatcggtaaaattctcgtactccggccgtccgtccgtattcatcatatcgtccagggtaaaatcgctttgctgctgtgccctaagcgaagtgttcacgctcccgtcctcttcccggttgtcccctttcccggtcagtgccagcgtaacggccagcaccaccagcacgaagatccccagggatgcgaacaggattatttttgttttcgtggccttatccatagtgttactttttttcaggttcttgttctatccggacaatctgctgtataaactggttaaagaaaaatcccgtcaaaacaaagcgaagagcatcaataaagaggactgttttatattatatttcatatctaattaagttttcaatttacaaaaatagtttatatattaacatgattcttacatacataagcatctgttttcaactctaacaggacaaatgaattattgtctttatatgagttgatgtctacttgatttcgtgttttagcgattatcctcaatgtctataatccaatgattttatatgaatttgctaatgttgttattgatattttcttttcaggtagtgattctatccagtttctaatgccatagatatctaagattctatcgtcccctttatttatgtaatatgataagcaaagatgagtagcaggatcgtaaatatattcaatattagtcttttcataataaaatctataaaagtttctttcattaaatcctgttagttctatgcataatggtgattttaaagtaggattcagtttagtctctttcgggacttgataaatactcacgaatataagacattcgttcatcatcactgtaatagttgtacttctttttcgaatatttcatctttattttcgatttttgaagtgtcaacttattcagtacactacatattgatatctagctgtatagagtactatcggtaatgctatagagtttatgttcatgtcttaactgatttgaatcatttcagtataattttgattcaactactgattcacatttttaattttaaaatatgcaacagggttatttgtagtttaagaaataattcatatctttacaagacagcataatacttttgaaactgaaaaaataattattgcacatattgatactatctgtgttttcaagggttcaacggaaaaatgggaaaagaattttttatcccctcgtttaacttacttgtttgttttttattcatataagcaaaactataataatgaaacatttatcatatgtgttaacaccccctgaaaagtcgttacggatcgacttcatcaggtttacgtggctccggttcttgatatggaacgcctctaccgtctggtcgtaaacgatctcgttggccggaagcacgtataagagttgcgtattggcgataatgcctttcgtgtactcgttatcgggaagctgcgccaatgactggacgatcgtacccaccgccccgttttccttgcggagtttctggtaacagaacgccaccgtcgaatgtatgtccgcacctgaaaaggtgtcctttatagactggctttctgcgtactcgtcaaagatcagcatccccctgacggaacgatccgaaaggatcttgttctctatcgtatcgaaaaggattgtcataatgacggaaatcaggaacggatctttctttatcttcgtcagctcaaagacgataaaatcccggttctgcatatcgttctccagtggggacggcttgcacacgttctcataaaatccccccaaatagagaatgttattgaagatattataaaaacagatgacttcgaaaaacaaaaagaaaatctaaagtcgctgattgattgtaatatagattttcggaaacgggacaatgattatgaacaagagcttgttaaacatgtaaagaaagaaaaagaatttaattttgaagatgagctaattaaatggttttttcttcgaagagatgatacatttaactatttatttccaaaatatgcgggtaaaagatttgaggaaatagccacttggcttcaatcaaaaacacctgatagtatagagtttaaaaaagacttagttgaacaggttatctcttatttgtcatcaattaatggcttagaagaaacaaattaattttatgacgaaaatttttggcatatatcctactgatagacaagaatctattacattcttgaatagaataaacacttatctttgcagaaagcttgacaatcaatggcattgctataagataaaatattctaaaaaaatatatagttcgattttcgctttttgggcgttcaaactcgtttgttgtccgattcgtttgcgtggttttccgacagtgaaatgatgggtggtccccagtgcgcccagatgatttgctgcatcttcggacttagcaaagtcgtgtgttcggtgtaacttgctgcggtgagctctgctttgagctgcaagttggcatctattgtgtcgcgcattctttttcgggctgcattgcagtccggatgtccttggaagtattccgtagctaattgggtaaaatgtttaaatcccttaatgatgtaatcattggatacttctttttcaacttttatcatattcttgtatttagtttttataagccactgtttgtggtttattttccgcaaagttatgaaaaataaattgattgaatagtataaaattatttagttttatttttcgtttttacatctgtaaatttatatgtatgtacctacttccttaaatttgtaattaggtatatttgtcaataatagatatccattctcatccttataatccctttgcttcacctgaggatatggataatgctagaatgctgagagatatacgatatggtatttattataaagataatattattaattatactgatcaaaacaatagcacatattctattaaagttaattccatgaatgatttaatgcgatatatatttcaacaattaagatgataatgagaaaaaaagtgattatttctttgatatatgtatcaatagtattgactattcccctggcagttgcctgtcaggggtcaaatgacgatagtatagatcctatacttttggaacatgtaaaatcagtgatagatttctatcctgattgtgggaagactttaaaagtttctcagtttgattctagaaaaacttatgtatatagtatgtggcctaagcaaagtggcttttggtttgatactggtcaaaatggggatgaacttaggttaattttgcctacaaatgctatgagatataaagctaaagagaaggacacgggatatagctttgttcttatcattataaaagaatacattatgaagttccttccaaaaaatattcctatagtatttggataaatcgaaccttttccatatctttgcaccgtcaaaaaaaataagagcaatataagttaacatttaacatatatacaatctatttatttgattataatgtgatagaaattgtaatgttaatcagagttttacgaataaaaactttcaaagttcaattttcaacaacatcacatccaagagcggaatgtagcgcagttggtagcgcactacgttcgggacgtaggggtcgggcgttcgagtcgcctcattccgacaaaagcgacaaatgattttatcatttgtcgctttttgttttaattcactttggtaacgtactgataatccatcagataattcaataatcaaattctttttcgttcgattcctctctattttcagtttaatttatttgcacgccaatagattcatttatatcgaatataataatgtgcactcctttcctctgttcctcctccatccaagaattttatgttctacaacatccttataattcaacactttagcttctatcctcaaaaataattcaaaaaaagagtgatttaagtttggagcatatttgaaaagggcgtacttttgcacccgctttccaagagaagaaagccttgttaaattgacttagtgtaaaagcgcagtactgcttgaccataagaacaaaaaaacttccgataaagtttggaagataaagctaaaagttcttatctttgcagtccgattcgcaaagaaaaggcgttttgtttttcttctttaccttctttccctttcgctaagagagtctgagaaacgatagaaaaagaaaagcgaaaaaacttccgaaaacatttggtagttaaaataaaacctcttacctttgcacccgcttttaaaacgaaagcaagatgttctttgaaatattgataaacaatacaagtagtacaagaaaaaaatagacatttatatactgtatattattactgtaaaacaatcaatatacttttgtgattcggttagatcgattacatttgtatcttattcacagatatatactttacaaacaaacaggcatgattacacaaacgtaaatatcaatagttgcaaaaacaataaatcaaggaataaaatacattatttacttatgtatattgagaactcttcaaatcttcttttacattttcttctgaagtatctcgcaaatcgtaaatccttgctatatttccgcacattcagtcgatcaattgttttttttcaattctagaagctataaaattgaattaaattcctgtcttataataaaatatacctgttttatcaatacccaaattaagatcaactagaaaaataacagaaaaatatcccaattatcccacaaattatcaaaatgacattttatcagttcaggaaaagaaagatgatccctccaatttatgcaaaaccatttatgctaatacgatttaccattctatatttaaagtgaacgggcaattagtaatgctcggctttgatgttaccacctttacacctgcatcctatcaacgtcatcgtctttaacgaccctaagaaatctaatcttgtggctggcttcgtacttagatgctttcagcacttatccaatcccgacttagatacccagcaatgcacctggcggcacaactggtaaaccagcggtcagtccaacacggtcctctcgtactagtgtcagagccacgcaaatttcatacgcccacgatagatagagaccgaactgtctcacgacgttctgaacccagctcgcgtgccactttaatgggcgaacagcccaacccttgggaccttctccagccccaggatgtgacgagccgacatcgaggtgccaaacccctccgtcgatatgagctcttgggagggatcagcctgttatccccggagtaccttttatcctttgagcgatgtcccttccatacggaaacaccggatcactatgctctagtttcctacctgatcgacttgtttttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcactctataaattgtaaattcttctgaaaattggttataataatccaattcctcattagtcattctatcagtcaatgaatatttactcaatatagaaactaatataaagcggtcatcccgagcaggataatccatttgataaacatgtttccaaccaaatgcttcaacctttggagacattttacgacgaatactgacttttagaatgaagttatcaatatagaaatcccataaaccacgactatccctactacagaaaatggataataaaaggtcttctgttattacaggaacagtctttagtacattatggtaaccaactttacaaaatctaaaccaatctatcttattgaatagagtattagcattatcaaagtcttgtttcttcaataaagaacaatacttctgaaatagttctatctgcgatgtgttatccattgtattattattagacatttctcttcgttttaatttgcagacaaagttaatcatatttataataatagccatattgaagagtaagaacccgaccgtcttgtctgcgcttcggtgcgttcccctttcccggcctccggtatctttggcgtacccggtaaaggcaagcaaatcccggcgttccataaagaaagaactttcccccttgatgtaggtatagtttccggcctcgtccctttcgatcgtatatcccctctccctcatggccttgtttatctgccttaccgtccggtattcgggatttgccaggcactccctaagatcctcgttcctgactgcgtacccatgcttgtatcggtctatcagattgatctcattctcgtatgcgtatttccggatcgccgaaatcggcacataggttttcgtttccctatcaaacagtacatcataagacacctctttaagctctttcctgtatttcaccggatcgggttcaggcatgggcgtttccgcttcgttttccgtttcttccggatgtgcctcgctccccggcgtttcctgctgtggctgctgcgcttcctcctttgtttccggctttccggtcacgcttttatcctcttccggctcgatcggctcgtaatgatttaaatattctgtttaagaaaggatatattgtgttatgcactattcacgtgaaaactatatccggcaatgatagtgtaccggaagaatatataagggagctgttgaagaatgtatctccttttgattatacaagtgaatatgtttttattaaatttcttcgtgagaggaaatggcttaaaagagattgcaagaataatattgaatataaagaagtacaatcgattattccattagatttagttgctaaaaaagatatggaaatgagctttaataaaatgataaagtttgtagaaccattgtgggggacttatgtagatgatttctctcagtctttatttagtgaaaatatgtgcaaaggtgcatctgcttgtttagagattttgggtattaaagtagaaaaacctttaaaggatttagatgatgaggatttgattattaaggtcacaaattatcgatttcaaaaagaaaatttggatgagaatagctcaatttggcaatatttattaatgtatgaacgtcacgagccatatcccaaaataaatagttgtgcttggctgttatgattcatttttatatttaacagattgggataagttgctctagaacttggtagttttataccaataagtgtattttttcctgttttcataggctattcaaaggttattaagtttgtgtgctacttaagacggtgtaaagttattaataaaattggtgaacgcaatgttttttttattttaattatcggcaaacgatgttttttttaatttttcattctactactcagatcgtaataagatagatataatcttttaattattgtatattgttgattattagtattttatcgctttggataccaagttctagagcgacttattccaatcggtcaattacgactatatttcttaataattatttatgataatgcgaaattataggccgcctccgggctgtgattaaatttttattatcgtttcttcagcatagatcagaacagtgctgaagagagattgaattcattaaaaatttcaatacccccaagaaaaacaaatgaatgataacagtcaaacacaactatatatatctaatacagatcccatacaggaacgtgagaaaagcttagaaagtagggataagttagaattgcagatgaaagataatacttacgaagaagattatcaaaatatgccttctgaaattatatctttctatcaagctgttagatcattggaaattgtaggacaaattattaaaaataggaaaggttctatttcaaaacaaaagttacatgaaatgataaaggagttgtatctaactgcttttagaactataggttttttggggaaaatagtcaaaagcactaaagaagaattgactatttctattcagagtaaagttgaaaaggctgattctaaatcagaaattgctgaaagaataaatttattctttcaattaatgtcttttaatttttgcttgggtattttctcaaaggtgatcaattcagtagggaatagagatcttaaacctatttttgatgatgtagcaaatgaattgaatactcctgctgcgaaactaatatcattttcaataaagacgtgctatgggaaattatcaatacccgagttaagattattatataaagccgccttaatagcggacgggagttgtacatccagaaagggggcaggctgggacggaagccgggaagccggaaaacggccgaacagaggaaagaggaataccgggaggcgatcgccttgttgaagaaaggctactcgatccggaacgtggcgaagctcacgggaaaggccgtttcgacgatacaacaagtaaaaaaagacttcattaatagctgattatcggaacaaatattgtatttttgcaacaaatacgagtaaatgcacgtaattaaaaacgagtatttgcacgaaaataatcagaatctaaataaaaacggttatggcaacaatggcggagaaaatggcggcttcactggaggaattaagaaagctccaggagaaagaccgctgtgtcgtcctgcaagggacggccgagatagggaggacgcatttaacccggctgttggataacggctggttgcaggaagtaatgaaaggctggtatattgcggccaggccgggaacagagggggacacgacggtctggtacacctcattctggtattttattgcgaaatacgcggcccggggaaatcaaatatccacgtgttgctttcatcatcggtcggataaaatacgaccctcatgccttcaggcttgtcatgattggaaatcttggtccagtcgaatactacccgcaccgtggcaaagtgcggatgatcgtaacataaatccttatgctcacaagccgtcagtcccatccataaaaatatgaacaccagactaaagcgtatcagtatcactgcctgcctcctttcttctcgttgtagttgccacggcccaagagccatacgagcgaaatctccgcctccgtgagaccaaaccagtggcgccgtcgggtctccttccagacataatggccgtcgataggggcatatttatggtattctccaccccaatagcccacaccgatgacgaaatccagattcagacgacgggcgacgggcagcgaataaccatactccagacctaccgaatagttcatcttatcccaaagcgtaccgccaggcttgccgcccatgtagcccgtccccccggtctcgaagtcgtaggtgaatatccgaccgtagagaccgatgtgatgccctgcaagcggatataagggattaaatgacatattgaaaccttaggagaaggatgataatgtatagcactagtcaccgttgccacttgaaacccatttttaatggcccgcaactggtattctgtttcacacccatacatatacatttccctcattatattaccatttttttcaataactctcctatgaataaatgtcccattaaatggattgatatttccttttattaattcttcgcgttgagtgtcaattgttttttttgccccaaatgcaattttttcaggattatctatgttacaaactaatgcatttgtaaaatacaaattattttttactgtcttattcaataattcttctaactgtcctttatcagcaactccatcatcatccatcatccagatccaatcatagccatcatcataaggaacttgtaggcaagtataaaatccattggcaggtcctttattttcatgaatagaaatcaccgttaaatcattttgcaaagaaagccaatgagcagtaccatctgtagatgcattgtcaataacatatatatcaaactcttgatatgtttgattacgaatactagcgatatgaacgttacctcttacgggacggacgttctaagtacgggggttaatgcggtgagcaatgcggcaaagagcgtgttccggaagaagaacaaccaggtcgttgtcaccgtgaagtcgaactataaactatatctgaaatgaaagctatttgttcttttatcctggcgttggccgtttcctcggccggggcgcagatccgcccggtggaaagcctgcctatcgcagtgaattattccaagacgatacatcttgtattcccctcggccgtgaagtataaccaggccgttacggacttcgtggccgtcgataacccggagagcgtgcctaatatcttgcgcataaaggccaaccggaaaagtttcagcaagcagacgaccgtcagcgtggcgaccgagggaggttttttctattcgtttaacgtgacctatgccgacagcctggagcatacgaactatttcctgcccgatatgtcgagcatacggccggacactatctatctgaatgaggtgtcgcaaacgcacctgatcgcaccggaaaaggtgatttatatagattacggcgatacctgcatacaggatataggaataatgtagaattcataactaagtgtatggatcctaattttagcttccaatatatttattatgatattgatggacaatttctctatgattttgtattattacctaaggattatgattaatacttttttatggaaacatttagccccaaagacaaagtagttgatattattaaagaatatcctacaacaagaattttatttgatgaggtaagtcattttgatgacacagcttcagtagaagatttttgctttaaaaactctattgatattttttccttttggaataaattgtcaaaagaaatgaggatacaaacggaagataaactacggcttgattctattgctgagcaacaaatgagagaggagaaaatattggctgatagagatctggaaagatataagcggacacataggaatcttttctgtgaagaaacaaaatatatgcctaaagagggcgtaatctgaactctgtccccaaacaattatctttgtattatggatagaaacagtgaagagtatcagcagatgcgtgacaaagcgttatctcaactgcgtagtggcgaatcgctcacgggcaatagtacattttataaaaaggttcaaaagcaaaaggaaaaacattatcaactaaatgttcagtcatcgaaggaaaaaggaaataaatacataaaaaaaacaaaataactcccagtagtatttttaaaacgaacattaatttagtcctgtaacttagttgattagaaattataaaaaagatacctcctaaacaagccccaacaaatccagttcgtccagcaaaaatagtccccatcaataatagtataccaattaatgtacttttcatattgactccactgagcaaataacgtttcacaaaaacaatatatataagtccataagcaagccccagactccatcctactcctgaagaaagagctaatccacgtacacctcctccataagcatcttgtaaatcatgagcacgactaaaataaagaataaaatgtgcaaatgatggtatagacatagctatcaattgaataatagattgtactagaaaagcccatataatagtttgctctatttttaacgtggtatattgtttctgatattttaaatagataataatgaaaatgccacaaatgaaatgaaacatttgagcaatcagtactttaatatactcgcatataattgactgctataatactttattttgtcacaaatataataattacttagtttatttgcccaaagattttaatataaaaatgcctaatctctggatttagtaaagattttaactgtctacatactgtttgagaggtaggagctagttgtaaatatgcctgtttcatagtctattattagttgtatctagttcccgatagatacaattctacatacaaataggtgcgggaactgccaatgtatatgtctccaagcatcgccaaacgctccaatcacaaatacacaacagtaacccgcaccagacgatatatgaactatcattagataggcatatagcactagtgcggtgttgtgcacgttcctgtgattgtataaattttggcgaatttagagacaagaactatgcaaaacacctttcgttaatatgtcctcctatttctaggattggcacaaagataatgaaaggttttaatatgtaaataagatatgtcgattaatcttagatttcttactcttcaatatggctattattataaatatgattaactttgtctgcaaattaaaacgaagagaaatgtctaataataatacaatggataacaccattttcattattggggagtaggatataaaaatgaattggataataatgtttgggttgattcggttaataagataataaatattgcttatgtaactcgcacaagcgactttacaggttcacgattgtttgctgatatcgatctaaaagggggattttcacctaatttgaaccaagtagaacagatacgtaaaaaatactgggattttagtattattgttaatattcattggggaaaagaagatatatcatatcctgaaccggataaaagagaattagcgcataagctaattgatgcaggagtagatttgattataggacatcaccctcatataattcaacattgtgaatactataaagaaaaaatgatttattattctattggaaatttttattttcctacaattgaatataaaattgatgggagagtattctacaaaaatcctttaaagcatcaaaaaataggacttgttcctataattgaaataaatcatggtgttattgatagaataataacttggaaagtgaaaatggaagattctggtgagttgagttggactaaaaatgtaagtctttcctatttaccttccaacatgctattttataaacttatatgttatagaaaagtgcacgcaaaaaaagatatcggcacatgccataaatgaatttcttaaaaaagaatatataaacatttttagagacatgagttcatctgatttcaaaaattttctagagaaagacatcctaacttatacaaagggtgctgtagaaaagaattttgagaaagtgatattgactttcggatggagccttaaaccttcaattctaaaaaaaaagagttttgacttagaacatggtatatagcataacaatacagcatgataccataatagtagctgtttcaagcagacatgttgtcacaattcctgccaggtttaatggaatgattctcgggctttggaacttgatacagattttcgttgcctactgtaatgagaatccgaattgggtgagtaatgtccggtcactgtggggtgaccgattcaaatagggacaggtatggaacggatgcctattcatgcccctattatagctgacacatggacttttatacattcttgcactttttaagtgggtaaaaaagtactatttgtattttatacaaaaaattgtttgcttaatgaaatggaacatacattgccaatgatatttaatacatgacggggatttctttcagttttatttggggacggacgatcggataaaccgggctttgctggagaacctggggattaaggtcgaacccgacaaatatccggactatgatagccggattgttgcgcaggtcgtccagggaaagaaaaggtttgatatttatcctttcgagttggaagcctttaacagatatgccatgtttggcaataataatgcgctttcatgcctgaaagggatttccccgacagccgggcagaccgtccgggaaaacggtattaacgagtatggaaacgccttgaattggtcgctgttctggataaaggcaaatccggaggacaaagccctgttagtggatcacgttttgaatatccccgaacgatgatagcggaatatttcatttaccggagaaagggggataaagagccgtttatctccctgggggaaatgccgcaatacgggttaaggccgaaacagaagtttaccgggaaaaaacttaaaatagaggtgatccgcaggctttccggtgtggaaatcgagcagacggccaccactccgcagataaacgcctatatcgaggcgaatatctatgataccgaacgttggccggagtaccggaagttataaacagtggttccagccgatggaatgaatgaaacaaggcaggaaactgatcccttacttatatgattcaattaacttgaccgcaccaactgttcgattaacctgctcttccaagaaacaataaatcatttatcactcaaaaacagcggagttatcaactattaaaggatgatttatcaattattaatgtctgaaatatcaatcattaataattgacacctcagacattaatacactgtaaatcaaatgacaacatcaaacaaatgacagataatgatacatggaagagtgagagcaaacacttgctctcataactgctaccacacttgctgccatacctgaaactaagatgaataaaggcatacagacaatctgttagggcatgagagcaaaagtcgcgttgaattactgtggagaaagcataaagcaaaatgtctgttcatttcaaatagaacctttgtttatctcaaatataagttccgctttaagataaacaaagagtcaatgtgcacaaatatataataacaagatatcgaaaaaaagtctcaaacacccaacacttttattatcctttcaactagtaatagcaagcttaaatactatacatattcatacacaatcaacaaccatctgagagcaaattaagtttaaacgccgcaaaagccgaggatcacgaatttgatctgtctctaataacatcaagcaaagataaaaaaaataatatatacttgtgtataaagggtagcttcaggaaggaggagtggtcgaagaccgaggtggtaggaaaaataatgtttatacctatttctttgtaaatgacaggattatgtattcacctaccacctccccctacgggtactcctccttcccgaaggaggagaattgaagatagaaccgactatcatttagctcaaaaccgtgcggaaatgagctatacagtttggacatgaacataaactctataacattaccgatagaactctatgtggttagatctcaatgacttatagtttcctgtcatttcttgtaatggaaactgtcgtttcccggtgagggaacgggcgttccttttaatggaaacgaccgttccttttaaagggaactggcgtttcctccgaggaaatgatgtgtactggttttagttgacaacttcgtttgttataactgaattagtttactcaatatactttaatatctaaataggtttacttttgttattcttattcctatgttagttgtcttttgttggttcatagataggggtattatattaatatattctgcaataaaaggtagtattgataatgcaaagaaactaattcatattggcttaatgtctgactctctgtttacaggctgattagatacattttataatatgtctgttataccttgctttaacactgatagattaattataattgtttatcaagataagcctttagagctgtacctaacttctcttcatcttggacttggtcgcttttaagcatttcgaaggttatataagttctattctctataatcttatcgctaatctcactacctaatgtgacaccattggggcatacactaaaaatactgttcgcatatttatcattatttacccgattaaaccgtgaggttgcattggtcttaaagaagtcaaacattgtttgtaatttaggtttggatatatcctttagtttccgttctctatatctgtcaaataagtggggtgtgtaaaagctgaattcatcgaaattatctcctgctatcattactgcatataaaccttcagatttgtaataatacatatataaaacaaatataagtccatttctcttataatcagcccaacctttactgacaaactgtattacgcagttatttcctcctttctggtatgtcaggaaagaaatattcttggcttccaggccgttttcccggtaggccacgccctcctgcttgtacttgtacaggttaaaccgttcgataatgccctccatgtggcggctctccagtttcggatcggcgaattttttcagatccttgtgccgtatgctcacccgttcaccctcccgtgaaaaggaatgtacccctttccgtaccttatgcgtgtagccttgttctttcatggctacgacaatctggttagcggacgtaaaacggtagttctccaacaggtttttaagctccgggttcttgatcttcttcaagacggcttcggccgtcggttcgcttttcaccaggtttatttgatgctcgtatgcgaactgccggacggtggcgaacgataccgtcgtatggttttgttcatcataaaccactttataagcgacctctttcaaggccttttcccccttctgtgcttcatcttttacatatgtcgagaaacttatatcctttacctgcaaaccgttctccctgtacccggccgggttcgcctcgtactttgtcaagtcgaaacgttccgttatgctttttagctgctcgtcagacagaggttgttcgaacgctttcaagctactacaaaatatacaatgaactattgttcataaattctatagaattgaaaatcattaatttaagttcagttctttttccataaataattctacctttgctttgtactcatgagacaaaaaattatcaacctttaaaccaaaagtaaaatgaaacgaacaaatttatttttcggtttggcatttgcattattctgctcattgccaatgtatgcacaaacagtatctgaagatgtagatatcaacactacatcagaatctgcaactcccagatttgtcaacatgttcattaatgataatggtgccatttatcccatttacgtacccaatttatctgaaaacacaaagattcaggaagtttggaatgaagcctctgctatcttgggcacaaggtattttgatctttactataatggtcaaaagttgagcttagacaagagtttcgctgattattggatcacaggtaatatttctgtttaccttgaagttagaaggcgttaagttaacaattacttttcttacagagagagtgtgttgtccggagcacactcttttaaacaaatactttttcttagtctatttctctctcttgcctaaataaattatatatactatattgatcaaacacatgcgccacgccctcgccccttgtcgcatcatacccggaaatatacacccggccgcttccctttacgaacctggccgacgctttcaccccgtaaagttccgtatcaagctgcaaataaaattccgcttcctccgataccagcataagatccggcacgttctggaaacgtatgtttatctccgggctggaaactttcagtttgatgctgtcggatcgtgtcaccagttcgctggctacccccatgacgatatacgcctctccctcggttgccgggataaaatcgaaatccagccgattgtttgccttgaaatcatattcaaacgtttctccggggctgtattcgttgttatccaccaggataacgccgtccccgtccctgacctcaaagcgtgtcaatatctgatccccgttgtccggatcgagatccgagatcgtaagggtgcaattaatgggcttccccactacggccgtattgccgtctatacttttcagcgtcacggaaaaatcccggctgacaagtttcagttcgtcgtcgcaagacgacaaaaagaccaaagcgcacaaggcggtaactaattttctcatacgatttattttatttgttcacgataatacggtcaaacagagcgttcagatccagcgatcatgggtgtagccggatatagcgaaatggcgcatatgcttggtttatatgatgttgcagagaaatatgcaggtatagccaagaaaatggcggtgaaatgggaagaaatggcaaatgaaggtaatcattaccgccttgctttcgaccgtgagaatacctggagtcagaaatataatatgatttgggacaagatgtggaatctgaatttgttccccaataatgtaatcgacaaggaagtaagttactatttgacgaaacagaatccttatggattgccattggactctcgcaaagagtatacaaagtctgactggattatgtggattgcagctatgtctccagaccaagatactttcgaacagttcataaatcctctctataaatatatcaatgaaacgacttcacgggtacccatcagcgactggcatcacacagatagtgggaaatgggttggttttagagctcgctcggtaataggaggttattggatgcaggtattgatgaacaaagtcatgaataatcagtaatttaaatctaatttattatgaatttaaaaagtaacaagaaaagtaagttttggtgtataccatacgtcatgcttacattattagccttttttttaggaagctgtgtccttatacagtaaagattatctctcccataatggatataacaggagatattatagaagaagaaagcgaataaaacaataaaaataagatgaaactaaacatttatttaatcggagcattcttcggaatgcttattctagcatcatgcggcaacgatgatgatgaaactcccgttcctaaagatgattcatggtattggggatactttaaaggggagataaacggaaaggaaatatctctggaaaatgaagctcatactgattggtctgttcattcagtaaaaacaagtgcatctcctcctaataacgataccgattctataaggggaatgatgacaagcataaagtacggtgaggatgaattacttagcataaccatctatcatttacataaaggaatacgttatataacaaaatcaacaaaaacagattggatatatgatggaattcaaataacacgtgatacacatagtgataaatatgaggacaaatatatttactatatcccccaaaaagagaaaccattccaagtagaaattactaaatctgcctatgcagaccaatggcatcctattattgaaggaaatcttaacggagtgctttatcgttcagataaccctaaagattctattataatcactaatatgttgtttataatcttctctaatattagagttactgaagcaggattgctgatatacaaataacacgcacaaggaatttcctaaaatctacgattacactttccataatttactcaaaataaccagcagattcccgaaccgaacggttcattaattagataagtaatactataaaagaaaaagcgcgggaatctgtacctgttactcgtcccgctgtttgaggccttcgaactgcccgtagtagtctgaacgagcaacgcagaagcccacgccgatatgtataacaatccacgtatacttttatttcaaagtacactcaagggtataaacatatcccgtagacatctactgttgctttgttttgactactgcttaaagtgttcgaagtttcaaacagccaaagacaaaacgtcaagtaaacgtctttctttatataatatatctcccacaccaccctaacctcacgaattgaggtatcggcgtgagagacaatgcaaaactataaaaataaaattaaatatcctacttcatgccattctttttccaaaaacacacatatcttgggcaaaagcaatccaaactcatttaaatattacctcctattacttattccccaatctattaacaaataaattattctttattagtagtaaacgtataaaataaacaccaaacgaacaaatatgataaaagtattgaccgaaacagaatacaagttcttaaaagaattcattgccctgatagaaaaatacaacttacttttcactacagatgaaaagggagaaattgaagtcacagttcatagacaacaattagcaacagaaacaaatcagaattcagatttactacatactcccatacacttaggagattgtttcgacgaaacagaactaaattacatattagatcaaactgatgaaagaataaaacagatagcagaagaatatcagtcaaaagagatattcacccaacatctaagcaaaaacaataaatcctaatctatatataaataccccaccagtctttttttatccccacggcctctttctttttataaggaaggggtcgtcccttttaaaataaagacatcaactccaaactacggaaagcttcatatccgaatcagttatacgctaaattgttagtccatataaatcaagtatcagtatcatatggggcaagcgttggttttgtagtgtactgaataagttgacacttcaaaaatcgaaaataaagatgaaatattcgaaaaagaagtacaactattacagtgatgatgaacgaatgtcttatattcgtgagtatttatcaagtcctaattacattcctttttacaagtctttttagtttagctactaataatgtgagttctacactatgatataagactaatgtatcctcagctgagaaattgaataggaaatagtacgtaaatatgattttcttaatcaaaaaatccatttttttaagaattcgactattccctctaataccagtcaagtatgttagtttgcattcttgcgaagtcttgttgatattcatatatacccctgtgcttcctttttttttgacaaatgagattatttcaggagtatgaccacttctttttaattggtcaactacataatgcattttaagattacccgggacatttcctacgaatttatctttatcttcatcggctatataccagcctatataatataccttcttcatatatatttaaactcctaataaaaacactaagtgatttcctttcataagtttgtaaataacatcacagaatcaatatgttataatacataaaaggagagagatcatcaccaatactactggttgcagcttgtctaatgatacatatttccaattacgctatatataacgagagaacctaaataaactggtaacctatatctactatatcaacaaaatatttttaaagatttcccttccatattattgatatgataactatattacaatatacaaagccccggccgttgaacgtggccgaggtgaaacagcaccttttccggtacgtgaacggtttccatgacgacgagggactaagggatatacagtgttccgatatgataaggatcgggcagaagaaagggatattctttgccgtttgtgatgaaaggtatctgcccgacaggatgaaagtatatgttacggacagcactttgcaggaggcaaacagccagctttatatgtcgatgctggaaaggatcggcgttcatgtgccctgttcccatgtggtaaaccagatatggaaattcgccgggggaagctaccgggaggaactggccgagagggtgaagctgttcggccgttaccgggagtttgacaaggccataaaaagccgttatgacggcctggcctcgtatgagcaggagatcatcaacgaggaaaacgtgctttgcaaaacgcacctgaacgtgttgctgttggaggatgacgaaacgatcctgaaccgacagacggaacaggtaaaaatgattttcacgaacgccgggtttaaatattacattccaagttacgaggggctttataatatctttataggctcgatcatcggccgggaaaacaacctgaatccggactacctgtttctttcggatctgcattcgtcgctctgcatggggatcaattactctacgttccgcagcgactgtacttccctaataatggttgacttgtttatctctaatagctgctatgtgttgactagaaatattactaaccctggcagctgtttactttattatttattattcctgcctccggtttacttatttttttcttattcctttaaccggttgactcttctctttgaaagaagaaaaaagaaaggaactcaccctttttcctctttctatcccgctagcagggcattcttggtcttttcataagcaaatgtacatatttatttttaagcaagtgctacattcagatacttttctctgtagcttatccatcttttcctgataggtccttgcatttctcctgcctgtaccggggtaagcatatccaagctcatatgaggcctttcgttgttatagaagtgaacggctgttgctacagcttttctgacttcctgtattgaactaaagcgcattccttgcagcaattcattctttataatgccattcacacgctcagctatggcattgtccttgggattgccatcctctgtcatgctgggaagaatcccgttatgtcgtaatatggcaatataatccgcactggcatattgtacgcctcggtcggagtgatggatcaaacccttaatctcctttgcagctatgcgtctgactgccatttccagagcttccactgtgtaacagcttcccagagtatcactactttgtaatttgaactccctataaaaatagaactgtcaacataattctcatataattctttctttaaatcattggttttctcaatgtcaggatatataaatatatctttcaatttgatttttttatcatcattgaaaaataaaggcagtttcatatcattcaaagaagacaagaaggcctgatttgaatgaaaatcaagattgttatgtcctatttcttttaatgaaaacttttgttcctcctgttgtgagtagatagttccattccaatgaaatggataattaaatccaatcctattttctgtgtttatgatgaacacttgaaaacctgaatgaactttttttgcttgattcatttgtaatgcctctcctgcaaaaatatagcactccttatgtgtgtttaagtccgtatgaatcattccttgcctttcatgttcatgtccataaataactacatcagaaaagctattgatcagttcggaaaattcatgcttattattttcttctgtattaggatttaaccaagatgaatgatgatgaaaaactgatatatttatcgttgcttttgtattaatagtctcttctatattttttataggatagaaaagactaccaacattttcattaatagaagacatccaagctgtattaaaagaatgaaaaataacaacctctttttgtatatcatctatatattcaattcgaacgatagaaatcgccaagaagttcaagctgataaggactaaaggtcatgtcactctttttcatcttttattcattttagttgatacttatagtagtcaaccaaatccagggtaagacactctgtatagcccaaccaacagcccataagtaaccattgaaaacaaggcagtgtgacagcaaaatttgccgtcacactgccgtcacctactgttgtcacctcattaattattcatactcaatcaattacacccgacaccgtgacagatgacagcaaattatagttttttattttcatagagagcctggctgacacgtaagtaggggttgactaaaaagtccccctaagaatgttaatccaattgttgcggatggcagagttttttctttttccaatagtgtagaactttaaaagactcctgtctctacccttttttcgtattttcctcccttgctacgatttccccttcttcctgccttcttccttttcagtctttcaatctttcaatccccttttcctccatcctttcccttgtgcatacgcccgtgccctcgcccttctaacgcgcgtgtgaatataataatgtgcactcctttcctctgttcctcctccatccaagaattttatgttctacaacatccttataattcaacactttagcttctatcctcaaaaataattcaaaaaaagagtgatttagaatatactaaaattgattccttatatagaaattattgcaggagtcatttttctctgtttggagattcatgactatcgtactttgtattctatggccgaagctgatgcaatgtatgggggacttgctgatttttgtaagtacaaagagaatgtattttgtccggcatttttctggataattgttatactgacaggactcagttattggaaaaataaaaagatatattggattttaacgcaggcattggtgtttatggtcttttttagagctatgtttccgttttatgccatttttatagagttaaatccagtagtcttttatattcttccacttttgtactctacaatattctttgtggtagaaagaaagttgtttaaaatcaagcaaatagattctgttgatattacagttaaaacaaaaatcacggggatcggaataggtatcttatgtactatcatttatttcctgccctttttgaccgttttttgcttaatatgatagccgtctatatttatttttccacagtgatttgatagccgttttgctctcatgctctaacagttcgtctgtatgcctttattcatcgatgttttagcagttagagatccaatggtagcagagtgagagcaagtgtttgctctcactctgctgaatcgtattacgtatcttttattaaatgttatatcttgatatacagtatattatatacagaagcaaaactattaaatattgcccccaattccgtaagtaaaaagcgttccagacttaaactgaaactcaatatcacattcccgactaattcttcattatatgaatatttgattaagaatatgcattaatatccatattttatagagatattaccgatgtcatgttcacagtacatatctaaatcgtaagtgactgattatcagccaccgcctgtccatatcaaaactagtagttctcatacttagtccctcatattttaataactttgcagaaaacatttaaagatatgagaaagctaagtattacattattattaattgccctttcattcataacgatggaagccaatattttatcaacacacaaaagcaaaattttagtttttaaaggatggagtgaacgccagaagtcagttgtttttatacccatagaagcagttctcgaaggtcataacatcgaagtgcagttttttgaaaaaccgaacgagccagtcacgtttcaggttaaagacaagaatggaaacattgtgtttcaagatatgacaactcctgataacctggaaatctatcaaatagatgtgagtggcttcaagacggggcaatatgaacttctctatatagaaaaagatgtgactctcattggagagtttgaaatcgagtagacatcaacacatataaagacgattcatttgtcctgtcataacgccaatattaatcctataaaaataatatttatgaaaaacaattaccaaaggttaaagtttacccttttgaatattataaaaataaagatggcatcaagtcgcaatactcattatttcgtctgcaccgtattataacccggaaatttttgaaacagccatatttggctacacctatatataaagatgcttatattgattttgtaaatgaaattataaaaaaagagcggattgatattgttcaaaatgaatattttgaacagctatatatggtttatgctattcctaatactgtaaagaaggtgttcattcaacatgaaattcaatacattgctaaggaacgtctgattcagcagcgtgaatatccttctagcgtacgctatttagccacgatgcaacggatacaggaaattaatgcgttaaatgaatacgaccaagtaataacaatgactgatattgataagaatatcctgatgtgtgatggggtaagagcacctatttcagcttctccttcctttattcctttacctgataatatagcatataaggaatgtgaacggagtagtatctgttttattggtggttctggtcataatccaaacttgaatggagttacttggttcttagataatgtttggtctttgatactcaaagaaaatcccaattttacttttaaaattataggaaaatgggatgagaaaattaaaacagaatatcagaagaagtatagaaatttgtttttttgtggctttgtagataacttggctatggttatatctgaatgtattatggactaaggactcactattttgagcatattttctaaaaataatatcattaaaagccaaattattacgattggaaataatcttattgttattaccaagcagtgtcgcataaaacatcaaactagactctgtcccaaacacacaaagattctcaacagataaaaggatctgttcaaaaggttcatcatttggaataagagtccaagtttttccatgttgttctaacagaccaaccaaagtattcacaacactagaagcctgataaggatgtgctttaataaacacatgcgaatccgaaatataattaaacaacagattcatgcttgcatagaatttctcaggagttgccaaacgatattctacaattggacttaaaaccaaaacagaagcacctgaaggaatagatgtgaaaaaagtctcttccttaatccaagaaaccaaagaaacattctcccttaatacattatatttattattaagtaaataatatttaggttgaaaccgactctttttataaggtttcaaaaacggataatttaattgtacacgacgacaaaaaatattatataccttaaataataattctactagtaacggaaatttattaggagatgccttgtaaagttggtctttataataagcaaggccctcctccataaaatgatatcctacacatgaatgatgtgtgatgagtaattgaaatataggagtagttaattggggaatatatacagtaaaactatcagcaatcaagcatttaattttattcattattgatttaattataatcatttttatattcattcaaagaagaactttccattattattcaccatatctctgtttttttctatctttgctttgattaaaaagataaaacgatggaaatactatatataaaaggagatgccacagcaccgattggttcaggtgtcaaagtgattactcatatttgcaacgatatcggaggatggggaaaagggtttgtactggcactttctaaaaaatggaaaatgccggaagaagcctatcgccagtggtacaaatcacaggaagaatttactttgggagctgtacagtttgtaaatgttgaaaataagttatatgtcgccaatatgataggacaacatggcatttataaagacagtaaaggactccctcccatccgttatgacgccgtccggcaatgtttgaaggaggtagccctgtttacaattgcccacaaggcaagtgtacatatgccccgtattggctgtggactggcaggtggcaagtgggaacttatggagcaaatcataaaagaagagcttatcaccaaagaaatagctgtaaccgtatatgatttataaataaaatcagagctatttggtgaataacccgcttttcttatgaaacacttgacaaacggcttttaatgttgtatctttgaggaaagaaaactaaaaaagaatgagttttattaaaaaaatagatacataacacacacataaactgatatctctttatatccccggtcggacgtgtttaccggacaggaggcatacggggaatatacgaacgtgctgaacaagatcatggaggaaagcgtgctttcctttgacctgatccggacgatcatatcgccctcggtgagcatgaccgacggggagaggataaaaattatcgtggatctggataacaagctgaaagagaaccgggacaagatgctcgacgagagagcgaggtttaatacggtcaatgacgctataaaacggatcgcagccctgaaatcaacagccaagaagtgagcctatggaagtgatcgacaatgtgattagcgcatacgaggccgtcaagatgaacggcgtcagccaggggatcatcgccctttgttcctttatcgccgttatcatcgtgatacaaaagttcgtgacggcctggaaagaggcctttagcgagggggacaagcccgtcgatatgaaacagttcttcaaactgttctatatctatatttatgtgttcgccattatcatggtcgcaccgttcgcctttacgatcgtggaaacggcacttggaaatcttcagaacgaattgataagccattatcaggaggacgtggatctaagcattgacgaggcgatcgtaacctttacaaaggactatatcgaggacgtgcaaaggcggcataactgggtagggcagcagattcaggaggttatcatgctgccgttcaatattgcggcttatacgatactcctgtacgcaacgaaatatatatttttcttcttatcctcatcagccagtttatatttaattatattatttatttgtttctgtaaccagttacccgcaggttctctgaactcttttaaaaatttccttttaaaagaagaaaggggagttccacatagtccggcaagttcctttactgtcctggcatttctataattattgaatatcttttttttaaaatcatagtcatttcccaatatgggatggaaaaaggcggcttgttccgtttttgtataataaaaccgtatgctccagaagagctctttaagcttcgtttcatgaaaatgaacgcaattggctccgtcttccaaataacttattaaaagcttgagaaacaaatgcaacctgtctctgatttcaagaggatatattttatcaccgggggaatccaggctgttaagttgtgcgaatgaaatcttttcacaactttgcacggcattatcaaattgtgcaataacaatactccctttccctcgtgagtggatcttaaatctactccccctaccgaaacaaatcatattaccagccaaaagcttcattttttttccgttgcaagacatttccagttctccttctattacaaataaaatggaatcagtctcatttatctcctcatccatttctatatcacaaaatttgtgatatagaaatccttcccggatgcattttgtgtaattgtaacaggaagtatgttcttttaaatataatattcccattgtttctgttatttagtaaaaaatataaggttatattattgtgataaatataaaattctttatatccaatttcttgtaatttactctttgtttcatagtctgcatcacttggatagttagcatattcactctgatggttatgatattttatatcacatccactatacgccattgacacttctttttcttgatgattggtacctgcgaaaaaatgataagttgaactatccacgcacatagaccattctacagaagtattttgagttaaaaaactatagatatctcgattctgttcactagtaccttcaataaccaattgaccagaagatatttgaaaagatgtacctttaggcaattccattgttggagccccatcccatgatcccattgatacaagaacctcatctgtatttgtttcgttagagtaaagtacacgcccatccactccaattacatataaagtacctccgattactcctttttcttcattttgactcaatacaggcatttcttttcgaatttcatcaataagtgcccttgttaatttttgtttcataagtgtttgattttagttttgtgatttcacaaatatagaaacgatgggataaatccccatcttatttgcatcttaattatcagcggacttttctttagcttttaaatgaggtatttcgtattcttctatgattggtggatctattacttcaatataatctttaggctctctataccaaaataccttttttaatgatcttatatattgacttaattttctagcacctttgtcattataaaagcaatacccttgtacggctcattgtccccggcgatcgtctggatgctgtctatctcgcatttatagaccgccccgttctgcaccgcatcaaaataggccttatcattataatactttgagaacacggcattcagatcgttcttattgacataaaaagcggcgtgcgcctgattttttttcaggttcaggcgatcgaagctgttagcgtacccggtcgcctcggcgcacgtctttttcaccagggcaagaaacagagcctcgctatcctcggcgtgcgttttcaggtactcgccggatcgctccaccacgaccaccttatccagtgccgtaaaattcaccaccagtccccaggccagcaccaggacaaccaccaccagggcaaagcccaggcacaattttaagtttaccgctcctttgcgcttggcctcggccagtgtatcaaaatctttcagtatatcgtctttattcataagatcaggatttaaaacagttcacgacaaaatttcacgcttttggcaaacaggaaaagtttgaacacgaaagcgaaaagaagtcccagcatggtatatttgttctgtccgcacatgtgcatgatattctccgcaatgatagaccccagggcgttggctatcaggaacgccgggatcgtcatgtaacagacaaacaggtttttcaggtatgcgtgcgtataatgcctcgttttctcgtccatgtagagtattacggctatcggcgtgacgatctccaggagtataagatacagataccgggctgacgctcatagcatagtgacacaatatgtctatagaaaataaagaatcatcaaaagataacagattatgagcgcaaatgacaaattaaccattctttggacgactgacaacaaagataccgtttttaatatgttggcaatgtatgccttaaactctaaaaacagaggttggtggaaacatataaatattattctttggggagcatctgtgaaattagtagccaacgatacgcaagtacagactgaaatattagagatgttacaatcaggaattacgattgaggcatgccaagattgctgtgagaatttcggggtagcctctatcatcacaaatctaggtataactgttagatatatgggaatcccgctaaccgaatatctgaaaaacggggaaaagatattatctatctaagcatgatggaaataaaacatagaatacagttcggatgcgatacagacgaattggcagacaaggtcttatcaggagaaaaaacagcaacttcttctttatatgattattctcttatgaatcaagaagaaattaaagtcaatgaatgcgcttctatactagactcacagggcaaagaaaaatgtattgtgaaaattgaaagaatagagattgtagattttcaagatataacagaagaatttgctgtcaacgaaggagacggctgtttggataactggataaaaatacatacagaatattattcttcattattggaaaagatagataagaaactgacaggtagaacaaaattagtgtgcgagtggttttctgtagtatcctctaataattaatcggaggaatttcccaggcagacaaacgtgtcgctggcgaccgaaggggggaagttctacacgttcaacgtggattatcggcagcagccggaggcgttcgtctatgagataggggagaaacggccggagaaaaaggcgaacgtgatcctgaccgacaacattatcccggccggggaaagggatcaggtcatgagccgggtatataacgcaaaaagggggatattcaacaaggggatcgttcgcaacaagatcgttttctccgtgaacaacctgcatatatatgataacttgctcctgtttacctttgagatcgagaacaaaagcaaactgccttatgatatagattatatccggtattacatcatcgacaagaaaacggccaagctgaccgcatcccaggaagtggatcagcaggctttgttctcggagaattattcgcccaggatagaggggaacggccggatgaaatacgtgatcgctttcgataagttcaccattccggacgagaaagttttccgtatcgagatcaacgagaagaacggaggccgtcacgttctttttgacctggagaacagcgacatcgtgaatgtggaggatatttagccttgcgatccttgcgctgatccctgtcggccgggtgggggcgcaggacaaacgttcgctgatcgtggaggtgttgcagaccgcaggggattacggggacatcgccccggtgtgggggatcgtccaaaaggacggggatatttaccgtttcgtcccctctgtcgcacccctgaaagagaaataccggatctccgaccgttacggctcatcaattggaactcactcagcaaaagtatatgattataatttgtatatgtttgatttttggtatagctatcacattactctatttgctgtacaggcaaaaaaccaaaaatgaaatgaataagcaagcccttgagttgaataatataaaactagagttggctaatgcctttatagagttggataaaaagaaaaatcaattagtggtttcgcaaaaagagaatgaaagtagtcaaagtcgattagaaaatgaaattaaaaacttaacctctaattataagaaattgcagcgaagaagaattgttacgtcaataatttttagaaaattagtgaatatcgctgaacgtagtacgaattgcaatgaaccattactaacggagcaattatggttctctattgtttctgaaataacagaaacttatccgaatttaaaaatgtatttattagaacgatacccaaatttatcaagtcaggaatgggaatattgttgtttatgcatgtttaattttgattcgaaaaccgaagctagattgcttggtattaatcctagttcagtttctacaaagcgattaagattcagacaaaaattgggaatctctgctttataggaagaagctaacttgtgtgagtacctgattaacgagcttttaaaataatcctatttaagtagttcttttctgaataaggcaatgcatgctgctatattgatagtggcatgcactttttttattttaatgctctgaaagtccccttgaaatagtgaatgtatactatatgtctatgttgtttttataagttgttgataatcaagttcaggaagtatttttaatgcccttaatgaataatgttcttgataaacttgatatatcaaaggatggtttaatctcaaaaatgccttacgagtagaatttgaatagaacaataaatacatagcatctatttcatctcgtatttcctgataaaaagattcttttttcaataaatgatcaatataaaaagctgcttgaagagtttcttccgccaaagtaacagacctctgatgtgaagcagaagaagggtattgaatataattatataaagcttcattgattattttcactttacaagagcgtgctactaattgcatatatactgttgcatcttcaccaatcctgagatgacaaggaatatacataggttcatcaaacaactctctcctatatacttttgcccatagctcccaaccatattttcccctcaaaacttttttcaaataatcaatcttttctaatgttacatttgcttcttgctttaacacttttttattttttcgaaccacatgataaccagcaatcactatatcaacattcttttcaaaatgacaaataaatctctctaagaaatctgagactaacgtatcatctatatctagaaaactaatatattctccttgtgcctcttttattcctctatttcgtgcaatagcaactccttgattattctggctatacacaacaaacctagaatcacttttcgcaaaagactgaagtacagaaagtgaattgtccgtactaccatcattgatcaaaattgcctgccaatcagtatatgtttgctttaacaaggaatataaacaagcagagatataacgttctccgttatacacaagtaggatattatgaaaacatttatatcgtggattattgccaattttgaaggagttatattttgcattattttttcgataatagctatatttctatttagtaatccaccaataaaagacgatggaacaataatctcacacaaagggctacttgagcttctaatactatctgcagtttttattggaggattaaccttacaaacgaaaaatgctggtgtaggaataataaaatatttgctgatagtagcctttctcatttggagacctggcttagatgattcactaatacaaaatttcctaagttggactttcctctggatattatttattggaagtagtgtaattggacttatatctgcaatctacgcattcttaaactttgatgatgttgtttctctccgaatgctatatcgtaacagctgtgtatctttatttgaagcaaactggctatataccattgatcgatttgcaggtctttcactctcaatatttttaaatataggttggtttattatgatattaaaactatagcgtcatgaacaatattttagacaaatcattagattctcaatttgataaaattgaaaatcttacgtggttcccttgggtggggaaaggttataaatgtgctaaacgaaaactcttagtagttggtgaatctcactatctcaatgaagatagtgatgaaaataatgagaaaaggagagaattacttataagagataaagaacacactagaaattgcttatatgaggtattaattaataaatcttggtctagcaaaacatattccaatataatggaggccttgtgtgacaggggtattctatcagataaccaaatacacaatttattattctctttgaataaggataaggatatgggtactgtttctgtagcgtgcagtggtacacagaagatagacaacgatgtccaagttactcttgaaaaagataaggacatattaggcaaatataattatagcaattttgatattaatgaggaaaaatatgcaaaagaactcaaaaacgatagctatgaaatgccacaaatgaacgtgctcttgcgtcacgatgatattgatccgtatgctacattgcctattgttataaagcaggaagctttgtcctcactttcgcctgattcgacttactttattccactgagaatcaaagatgtgtctggatttcagattaaagaggaaaaacgaaatgtcctatgtcgtatttatacatataatgaatatgccaatacgaaagaggcaacccaatatacaatgaaaggatatcgtatcataggagataattcttcctccattagtggctataaaaatgttcatccgataaatgctaattcggtgagaatgttcgttgcgaatactaagtttgaggcaaatgaaaaaattatagctaaaaatgctgtgactgttgaagtgcaaaaagataattcgataaagatgtatccttacattcgcgatactaaaacgcttgaagttcatttgatgactccgcctaatgatagtgaagaggattttatttatcaaaatgtttatgaaaagaagaatgaacgctttttactatattataaatatcgaacaagagataacgaaaattcttggtggtcggaatggatagtagtgaaagaggctactaagcgattaaatatgcaaactaagtagtaaaaacagttatttgtataatacattatgctacaaagatataacaaaggattggaaaagtaaaaaaagaagcaataaaaaatcccctcactgtttgccaatgaggggattttgtgtttatagcgttttatgctattctgattattttttgaaaaagtcttgtactttttcgtttgcaaccatttgttcatcaaaaacgtaagctccagttttcggagatttcaccattttgataaccttggtgtaagcacgaccttctttagagccttcgtgcaaacttgctactgttttctttgccatgggttatactattattatttaatttccttatgtactgttactctcttcagaatcgggttgtatttcttcaactcaagtctttcagttgtattctttctgtttttagttgtgatatagcgagatgttcccggcattccactctctttgtgttctgtacattccagaatcacctgtactctgttaccttttgctttctttgccattgtaagttttctcctctacgtttagccgattactttaatgcttttccaatcacagaaacctttagctactgcatcgttcagtgcagcgtccagtccttttttgttgatgatacgcagaccgttagcacaaaggctaaggctgatccaacagtcttgttctacataatagaactttttgttaaacaagttcaaatcaaaggttctttttgttcttctctttgagtgtgaaacattgttgccaatcatggctttctttccggtaatttgacaaatcttcgacatttctatcttatttttatagttttatatctatacttatttcaaacaggacgcaaagtaagcacttttatccgtatatatatatttgtgtgtttgaaatatctattattaatatttttagcttcatttatcacctatcagataattaatgtttttatgtacattgaggttgataatataatgcaatggatgatgaaagcatgtttatgtgtaggtgtttattttattgtaagtgtagtattatttagaacttttgattctactttttttaaatttattaatcgtattgttaccttgatatacaaaagataatggatagagaattgcctttagtgagtgtaattgttcctgtttataatgtagaaaaatatctgagacaatgtttagattcattgatctctcaaacgcttcagaatattgagattatttgtgttaatgatgcttcaccagataattcattagctatattgaaagaatatgaagctaaggacaaacgaatagttgttgtcgatttatacgagaatatgagacagggtggcgctcgtaatcgaggaattgaatatgctcgggcgaattatattgcttttgtggatagtgatgattgggtatccgtagatatatatgagaagctttttgcatgtgcattgatgaatgatgcggatatcgtaaattgtgactattatgaatataggggggaagataatataaagaaatatataaaatacaaagagttaacttttaatatgctaaaagaaatagctaataaagaattcattttaagacttccttccccatgtcataacttatatcgaaaagctatatttagtgataatgagattcggtttccagagcagatattttgggaagacgctgctataatgtctttaatttttttattagcggataaaatagttaaggttaatgagcctttatacccggtgtttacgtaggttatatccgccactaccatagcgcccaatcttgtagcgacaaatttgggtgcaacattcaacagatcggggtagatatagtaattatggttcgaattcgttgttttaggacgcttgcgacttgtacgttgacacaaaccattggagcgaaaaatgtcataacaacgatcacgaccgataaccatctttggtccaaacttactcacgcagcaggcgtataactcgcgcataccagctttgggcatgagttccaacagttctttgcagtacaacacgatgcttgtggtaaggatatcaacctccaaatgtcggttcacatgcttgtaataaccttgtcgggttatgccgaagtaatcacagaggaactttatacaaccacgtttgcgtcgggatgagtacctctgtgacaaggtgtcgattacttggcatcggagttttttcgtaccttgatatgatacgtggattcagcaagattgatgagttcttcgcacgcctcgtgacgtaaactctcatcagcaagagcccgatgaagtttacggttctcagcacgcaatagcgatagttctttctggagctcagaaatactagaatcaatagcatcgctatttactggtttagaggatctacccatatctttgtcttctatttgatacttgttaagccaataagtaagaagcttggcacaaaagccgtgacgcttacaaaactcagatttgctctcgggacttgataaatactcacgaatataagacattcgttcatcatcactgtaatagttgtacttctttttcgaatatttcatctttattttcgatttttgaagtgtcaacttattcagtacactacaatatataattattcactaatttctaaacacacacaaaaacgttgttattttaacatttagagattatgcctattttattgacagtggagaatcttgtaactgcggatttgagcacaattcataaggaacaagctacttacgtgggaattgattttggaacatcaactacagtagtttcttattcatattttgataatgaaaagagaatagttgtaactgaagtaatgaatctacgacagaagcaaagtgatggtgcggactttactggagaaaaagtgcctacagttatagctctttatcataatcgggtacttgtcggagagggagctgcaaacttaaagtatgaattagaaaaaaacaaggatgtctggtactcttttaagatggagttaggagaagatttaggtgcaaaatattgtaatagtattttgggtaaagataaatctgtccgaatccaaaatgcaaaggatgctactattttatttttcagattcttaaagaaagagatagaatcctatgtcgaacaaaaaggactatgtcagaatattaaatatgcagtaagtattcctgcttcgttcgaggcgaatcaacgacgcgatttggttgatgctttaataagcaatcaaatggatgttagcaaacagtccttgattgatgagcctaacgcagcttttttaaactatattcatgaatcggagatgaataatgaagcagtggtaattcctaaagatattaatcctaaaatgttagtttttgatttcggagctgggacatgtgatatttcaatattagaaataggtgtagattataagggagtatattctaaaaatttgtcaatatctaaatttgaaaaattgggaggaaatgatattgatagatcaactattgaaaacaacttaataacaagataatgaaatatttatataaatatattgttgtgtgcaaatgggttgaaagctataaaaatcctattatattaaagaaagatgaaaaagttgtagtcaatttagctataaaagaaactgatccagaatgggtaaattgggtttggtgcatagcgggcaatggaatgacaggttgggtacctatacaaattttgaacgtatgtgagaccttaccgaatgaatggcaaatagctattgcattagaagactattctgcttatgagttaccagtaaatcaagacgagatagtaatcggctcaagatacctaaatggttggttatggtgtcgaaaagaaaattcaaccaaggaaggttgggtaccgattagatgtttaaagcgatctattgaatcattgtagaataagtattgccgaaatgataaaatattaccgaatttgtagaaagaagatatatattacgtaatccatagtaaaaatgaaatcaaaaatagacaacaatttaagaaatgcgaagaatataggtgcaacaatcgagaaataccttaatgaaattggtatattcactttagccgatcttgcagaaacaacatctgtcaaagcttttataaagatacgtgaacaacatcctgaaaagactatacctgtgtgctattatctctattctttagaaggagctctattaaacttacattggaatgatattccatcagaattaaaaaaagaactaaaagataaaattcaggattaactattagaacaaatttgattaatgattaggctattaaaaaaattagcagattgattcatttttacacttattaatatgacatatgagattacctttgcaaaaaacaataagtacaaataagtaaaccggaggcaggaataataaataataaagtaaacagctgccagggttagtaatatttctagtcaacacatagcagctattagagataaacaagtcaaccattattagggaagtacatttcctactgtggaactattatttttttgcctaatgaaactttagtttcacggccttggaactagagtttccagcgcttgaaactttagtttctgcagtttggaactaaagtttcttcagcttgaaactattggtttcaaggctttggaactatagtttcattgcatggaaactaactaagctaaggtattcctgacttatcattccaagaggtcagtatattattgtagcaggatataataacacagcgtgacggcattgtgatagcatattttgctatcacaatgccgtcacgctgtgctgtcacctctttattagtttataatcagtgcgttatctatcatttggtgacagatgacagcaattttggatattttaattctctagtagagcggctcaaagcaatttattcctttttatgtatgttatgagctaaatgatagtcggttctatcttccattctcctccttcgggaaggaggagtacccgtagggggaggtggtaggtgaatacataatcctgtcatttacaaagaaataggtataaacattatttctcctaccacctcggtctgcgaccactcctccttcccgaagctaccctttatacacatctattttttttaagaaataggcatataaagagttaaattaattaaggctattcatggtaagcatagtcattatttaatcttttttttcctaataacacctttaaatattccaatttgtaaggatttaaagatgtgtataaagggtagcttactttagattttctttttgtttttcgaagtcatctgtttttataatatcttcaataacattctctatttgtgcggaatatagaattacttgttttttgtaattagggttcatcgattttataatttttattatctgaaacccatctataacgcctgctattaaattgtaatcacaaacaatagaatcaagctgtctaaagtaaggcaaacctaataaatcagttttaaaagattcagcatcaaatagaatttctccattctctcttctttgataattaataggattaaattctttaaaaactaattcaatgccatcattttttagagtagcttttatgttttgtaagacggcactctgagattgctcatctactaatattaagtgtttttgaatcatttgaaaataatcttaaaattcataccattgcctatttcaggcttatcaatcgctattttggcattcatttttgaaagagactctgaaacgagatataatccaaatccagtaccattttcttttgctgtttctctaaatttgaatatatcattagggttcgttttatacttagaagataacccttctccatcatcatatatgtttagaattaaaaagttaccatctaacttagtcttaaaccatatatttttcgccccccattttgctgaattatctacaaaattatctatcatcagagccaaatcaagcttgcttccaattatataaaataagcggacattattaattgaatgtaccttaatcttatatttgttattcttggaataaccagatataaaatctgggagattaattttttgtgcatcagctttgtctaagtcactttcaagaatcaaatctgttgcttttagtgacttatctgcaaagtgtaaaatctcatatcctacgcaatacccaatgatctccttcgtataggcgtctgtcaccagagacaggtagcagaacacataactgccgtcaggcaaccatatggtaatgtaagtgatatcactaacccacagctgatcaggatgttctaatagcaatgtcctggttaaatcaggatactgtggcaagtgatgagaggagtctgtcgtacgtggagcccgaaaacgtttgcgtattgtcagcttatacttggacaatatagcacagaaacagtcacgcccaacaaaggcctggctggtgccgaactcattacggtacatcagccaaagtttcatccccccaataccagggtcctttgaacgcacacgtttgacaaactcaagaacaaaacgttcacgggccgaactatccgtactatggtcaacatacttataaaaggcttgctttgttacaccaaacaatttgcaaagagagaccaccgtataggcatgcctccctttacaaagcctttttattgtttggtaccagctttttttcggataggaagattaaacatctcctcggcaacatcaatcatcgtatcgaaggcgtgcgcacgcattttagcatctttaagctctgcacgtaaacgctcattctcaagacgtaaggcagtaattgaggaggattcatccgaggacttgggagacttgttctttttcatataagcggatatttcaggattagaatcctcaaagatacgaacccaacgccaaaatgtaatgcgggcaatccctttttcttgggcaaaacgagaaactgagaaattcgaacgatagaaatcgccaagaagttcaagctgataaggactaaaggtcatgtcactctttttcatcttttattcattttagttgatacttatagtagtcaaccaaatccagggtaagacaataatacatgaaataattataaagaataatgtaactaaaatccgactctgtttattgaataagcataaaaatccggcaaaaaaaatgggttctcctacagaaagaaaagttgccatacgtgcccctattatcacaaaatcattaaacagcatcaaccaacaagtagataacacataagccagataaagaactgaaaagcacgaaattacctcctttaacctagtccaatagatataacacaacacacacaaaataatctgtttcagtgttgtaaaattagtcaagatccctatctcattattaaattggtcccaattagcataagttgcaattctacttgtttcatcaagaaaagggacatatgcctttataacctgcccaaatggatataatgttccaataataaaagacaatagaagaaaatacatcaaacaactattacttttgtttttcataaaataatatacccaaaacattggaaagaagataatagaggacatatgtatagacatagcaattaccatacacgctatatatttccacagacttttatattcgatgtatcgtatggcatataagcatatagcacacgatagcccagcacgaatttgaacatattctttcagaagaaaagaatgtacaaaataaaacaatacagaaacaaatagatatggagaatatttacgataggaagatatatttaaacttacggcaattatagctaccggtaaaaacatataaattggagatgttgtaaaccaccttacaatcaaaacaaatgccgaaaaacccttatcaggagaaacttcccacgggtttttaaatatctctaaataattttcataatctgcattatcatatctcagtccagccaataatgataacaatacgatcacaaataaatataaaataagatcctttttttcgttggcgagcgtgcttagactgttggtaaggctgcttagatagctgctttgcgtcttggggctgtcctttgcgtccaggaatgccccggccagtacccggctctggtgcttgccctccaggaacgacgttatccggacagttccggccgaacaaatgaaattaacgatatggggtatcgtgcaaaactgcggataatcgttataaaaccggatcgaaacgccccttaatatccccaacgccccgttaaaccactcgtcccgtttgccgtcctttccctggtaggcggtcagcatatcatccattagctgcaagaacaaggtttcattcttcaccacggaaggacgtatcggatttgtccggtgcgtccgttccatatccgtgaaactgatctggaagcacccataagggtaattatgtttttttaccaggtgtacggctgtccttgccagatcgaaatccttgtaattatagacaaatccggcaaacccggcctgtatatactggcttaacaagggctttcctatgcttttggtctttccggagttcgccccaccatagaccaggaaattatcgaacggatcggcaaaggttattttcctccctcccccggccgacagttcaaaacggtatttctgtcctttttgctgctgtttcccggaatttggaagcaacagcacaacaacgatgatccccaccaggcaggcgatccctataataatatacatcatcatatcataactctttaaacgggtttagaaaactgccgatctgttttatcagcatcatttttatattagccgggttctgtataaggctgacggcctttttcacgttgcctacaagcatcctttccgtccggaagctatcccccaggatctcgtttatcagcttttgtttggccttaccaccgataatgattagatatatcattatagacggaacgcattccaaaataaagaaacaaaaaaaggaacaaattaacaatcatccctacagaaaaaccataagaagcatcaacattccgtccataaaaatctagaatataatagtttacaaattccccaaaaacaggtattttagtacccaataacagtattttttgtgatactcccaacattacaaaaatcaatgatataaaaataagagtaacaacactcttctgcatataacatctattcaacaagaaataaaatgggaaaaaggccaacgcagcaagttgaaagcctgcagctatcaaaagaaaaaaaacaaacttcttcaaagaacattcctttatatatgaaaaagctagccacacaaatgaagccataatcccgtggcgaactatatttagctggaactgacagaaaaacaaacaaaaatataaaagaattggcaaataaatatatccacatccaattcgtctaataactataaataatacgacaaacgatatcaatgacaatattataaaaaaacacgcataacttaaacctagagttttacataaactccctaaaatccaaaaaagaggttccatgagaattctatattctggatctagaagcgacggaatctgcctgttgtaaataattacatatgtctcccaatcagcccctatattataacgaaatcccaccatacatgctataaatagaatcacgcatcttaataataccaaggactgtctagcggaaataagttctacataactaaaaagaaaaagaataaagaaaacaacccaataaatcaacatctttaaatttgaatataactatttacaactaaggactcactattttgagcatattttctaaaaataatatcattaaaagccaaattattacgattggaaataatcatataatataaaacagtcctctttattgatgctcttcgctttgtttttagtagctttttgctttatagcttgtgatgatcaggacaatgaagagcaggaacaggtggggcaactcactcccgaagctctctatcaaacttcatggcgtggcaccggacattgtgccgcatggagtttgaaagatagaggtatcggtatacaattcgtagatacccaaaaaggaaaagtggtttgggaagattatgatgaatttgatattacctacatgatagaagggagctatattacatttaatgatattgcgtttcaacttgccggggctccttgggtaattaaaagttataccaaaaatcacataactcttatacaaaatgaagctagtcctgataaagataaaatagctacaatagagttggatagggtagactaattctttaaaagatatagtttgaggttataaattcctctttcaagttgtattgataatggaatgcatttaacaattagtaaagtgctatattataactagaagaaagagtgtatcaaaggccagatagaagtatcattctatcattcagagcgtagtgaagaatcttttctttgatataaataaagagtagatccttcggcaagcttaggatgacagagcaaaatgatagcagtcttcaataaattattaagtagagtctgctgaattacaaatacctgctgcttgttaaaatcaaattttagcgagcgcaggtattgaaattcaaagattaattgattagagtctcaatttaacaagaaattgagcatttcaaacaaggtatgcagaagttcttaaggggacctaaaggctaggccatctatttagattaaaaataaacaaggacataaaaagtaaataaatgaaaaatagttatgtctataatatttttatcatacttttgtacaaactacaatacatttatcatatgtgttaacactagtgctaatattttttgtagcttgtagacggcaacaatcagtgtctactccgttaaatgctgcagagcgaatactcaaagacaatccggatagtgcttttcgtataatacaaagtattccttatcctgataaactggataaggaagatttagtgcgttggtgcttgatagctggtaaagctgctgacaaattgaatacgtctcttcctccttcttactatttcgatcatgcatattcttggctgattaaatatggaataactaaagatcaagtagatatagggttgttttgggggcgctctctagtggctgatggggaatatgataaggcaatgagcatttatgcagaagtattggcaatcgcaaaagagaaagaactatataatgaagcaggctatatatgtacgtatatagctgatctatatgattttagggatatgcaaaaggaggccagacatcaatatgaagaagctcaaggactgtttaagaaagcgggaaatatcaaaagtcatgtatttgctttacaaaatatagctcgtgaatgggcctttttcgattctctggaatgtgctttaaaatatatgggaatagcggattctattgcccagcagttgaatgataatgaggttagctcttctctagataatgcttttggtaacatttatttggcaatgaaccaatactctaaagcagaatatcatttccttaaatcaacatctttggataaagaaaatgaattgtataatacaaactgtctgatcaagctatatctgcaagtaggtgatattttaaaagctcgtgagcttttgtatacactacctttagatagctctgaatatgaatatggtatagagcgggctttttatcgggtaactaaagcggaaggtagctataaagaagcacttaaacatttagaaacatgtgaatcatatctatatcactagagaaaaaacataaaataattagtcgtatgaattgataattagaatatttcaattcatacgacttttcaaatatagtattatgagaaaacttattttatttttcctatttgtgttttctgttacagtaggatttgcacagagtttttccggagataaactgtttatttcggtagatggtggaaaaggtgtattgttcggtaagtcaaacttgtcaccttttggtgttaattatcgtggggaatataatggaggcttgacgtgtaatgtgaagacactctatcgaattgataaattttgggttgccggattaaagtttaatctctccggtacttctgccaattatacacttgatgatgaaacgaatgtagctgacaatgtagaactttggtatttaggaccgcaacttggattcaaaattccaataaccgaaagaactttaattagttgcgtattgggagccggatatctacattatcgggatgaaggtcgaagtaatagtgaatttaaatgtacttccggtgcattggccgggaatatggactttctggtagaatataaattgacagaccaccttgcggtaaacggaggcttttctgttttaagtggagactttaagaagattgaaatgacagccgatgagaaaaaggaaacactacgtccaaacaaattggatagactctatatgagacgtcttgattttcagttaggactagttttctgctattgaacatcttaggtcaaaagattagctggatagagtgaaccttgaaagatatttattacttttgaggtaaagcttggtttagctgaaaggtatacgaacagtctgaataataaataaaaatagaacaatgaaattcatgaaaaaaaataggccagatgtgatgattattatactgcttattctttggggaatatatgagatattcgtagtacataccttatattacaagaggaaatcagacactgtttatccttgacagtgataatatctttgctgataataaagaacaggatcgtcgtttccttctacagacaggttcttataattctaatgcatattctttaaaatatgatattaagttgggacaggatggttcagatatggttccaggcatacgtttgagtgagatgtattatattatgggggaatactttgctcgtaagggtgaatattctcaagctggcaaaatgctggatgaagtacgttatgcgagaggaattctgactactaatatggagaacagtattgggtcattggaaggatttcatacagagttattgaaggatatgcgtaaggagtttgtaggagaagggcaaatgttttttcaatacaaacgtatggataagaaaccggtagataatgcaatctttgtatttgataaaccggataatgaagatgtttaatgtatgataatcaacgaaaaagaaagatgaaaaaatatattctatttgctttaatatctctttgtttttggggatgttcggaagatgagataaaaccttatcatggtggacaatatctttattttagccaactgaaggaatttggtgatgaggatttcgaagtatctttcaataactatcctactagtaatgctattattgtgaagattggtctggggctaatcggaaaaccgttttcaatagatacaccttacaaagtaagtgtggttgcggaagatgagagtgaagataagataaaaaatgccgatcagaaaaattatcgtttgcctgataatccaatgtttaaagctggactatctaatgatacattggaggttatgctgttaaaaacggaagatttgaaagagaacgtgaagttgtgtttgaaacttctcccaaatgagtatttcgaaggatcaataccggaatacgaacaaattaaaatgcccgtgagcgattcgccactacgcagttgagataacgctttgtcacgcatctgctgatactcttcactgtttctatccataatacaaagataattgtttggggacagagttcagattacgccctccccatttgataagggatgtagagagaaggtgaagggctgataaattatacagaactattccgtattaactatggtttcaaataattttccaaaggttccatagacaattcatcttgatttgctccccaacaataataaggctttttatccttaaagaaacatatatgaggataagtattttctcgagttaaaataaaaaatgtcccatcatcagaatgctctctagcatattcaaacttctttgtttcatttttctgcggtgtaaacgacataatttcccatctttccgcttctgtcctctttatactactttctaccatcttgtccgcagcttccttcccaaacacttcaacatatccttgataataacttttcggattcgtgtctttcataaagttttcagcatgatatatagcataaaaatatattgtttccccattatcattctgcccataaaaacaagcaaacttttctggaattctaaataccttttctgaatcgttcactaaatataatcttgaaggcgaatcaataaccggtacaaactttatagtggacttcatcaaagttaaggacaaggatgaatcattccatctccctgcaatattcatgtttaatcgttcaagtatggtatcctgaacatttttattaatctcctctacaagcagtttgttttggggtgtaagttgactgatagcttgagtaatcatcttatctctttttataacttgcttggaagtgccatcgacatacacttgttcgctacatgaaagtaatagtatctggacaagaaataggattgataatttaattgttttcataatatttcttacacaccttgtgataacgggcattatacgcagttgcctgatggatggacgttttgtaggcttgaccaaattataggttatgaacagtctacagcttatattgtagaatcgacagcttatgatgactcttattcaaccccagttctgacagccggtaaatcatttattattggttacactaacgaggctactggtatatactcgaatcttccttgtataatctttgatgattttacaactgattcgaaactagttgatttcccttttaaggtaaagtcatctgcaatgaagattctaaaagtacataaggacattgaagttgattatgtggcaatgtttatgagcataaccaaattggtaggtgacacccataaacgatattggatttctgaatactcaaaattagagataccaataccatcgaaggcagaacaaaagcgaattattcatgcaatccatggaatctttacacaattagatttaataatggagagcctataaactctccattattaaatctaaagacataaaagccttggttatagcctttataatcctttgttgttctttgtaaggtggaataggaatttctattgctttgaatagtttcttgttcaagtggggaatagcagaaccaaccttactttctcgcaagactttcctatgcaagttgattgcttgtagtacatattcttcgttcatattttcgttgataagcaactgtttgaaagtactaccttgatagccgtcaatcgaagtcctaaatacctcaccagagttctcgccatctactaaaatcaaaagtgaatttgcagtaacatattttccagaagtcaaagttttggcatcacgctcaccacgcaaatatttgacatcaagatttattcgttctattcctttttgcttatcaccatcaaccaaagagcatagtacttgcataggtgcaacagtccatccattaggcaactgcgtataatgcccgcttatatatcaacagaatttaaagcaaacccaatataaactatcttcaatgcagactattattgaagataatcaatcaataatcagtttgctgcaagaagaacagcgcaatctgaaacaagaccaagcgaataagatagatgaaatacaggaaagagaatctacaatagaaagacttagacaagaaaagcatgaactgagaaattggttatttacccaaagtgatatatacaagagaattatcgccctctcgaaacaagaagtatctgacaaaaaagcaatgaaggtattaacaaatgcagaactaaaaagactccaaaagattattttcgaaatttatgccgattatatatcatacttacaaaaaaagtatcccaagttgactgaagaagatattttatatctctgcctaaatgaagcaaaattgcaacctctaactattgcactttgtttcggttataacaatacgcaccccattaatcaacgcaaattaaggataaaagagagaatgaaagacgaagaaatgtaaagtgtgaccagcattttactatctcattaattatcaagatattacaaaacagcaatgtgactgcaaatattatccatctatactaatactccatacctttgcctccataaatcaataaaagaattgaatatgaaagcaaagtttttatttatcttattatcggtattatttattataccaacaagtgcagcaatactaaataagcataagcacaaaattcgacttacctcatttactctaaggaataaggcaacaactcgttcccctattgaatttaatatagatgtacaagaaaccaacagttgcttgcaaattatctttctgtcacctctgccggatgcagaaattactattacagataaaaacgggaaaaccgtagttcatgaaccacccactttcataaacaaaggtaaaacattgtatatagaaactccaaatggttatccttataccctgtagctagcgttcatcctgagccaggatcaaactcttcattgtaaaagtattgttagtcagcataaagctgatttttgctctgttcaggatgccgtacaatttattgacttcattaataccttatgactcatacatattactacatataagacaagtattgacggttctatttttttcttgtactacttgtattgtttatcaatatttcaaagaacatcttgctttcgttttaaaagcgggtgcaaaggtaagaggttttattttaactaccaaatattttcggaagtttttttttcgtttttctttttctatcgtttttcaggctctcttagcgaaagggaaagaaggtaaagaagaaaagcgtaacaccttttctttgcgaatcggactgcaaagataagaacttttagctttatcttccaaactttatcggaagtttttttgttcttatggttaagcagacacttgcttttacactaagtcaatttatcaaggctttcttctcttggaaagcgggtgcaaaagtagccccttttcaaatatactccaaacttaaatcactctttttttgaattatttttgaaaagactcgctaaagtgttgaatcataaggatgttatagaacatatttttctcggatacaggaggaatagaggaaaggcatgcacattattatattcacacgcgcgttaggtgagtgagcgcgggcgtatacatcagggaaatgaagaggaaatatcagattcatgaaatagtctgttatataaaacacaggatagatacagtagaggggagctctggaagttgaaagtagctgtcatgagtagtcacacagcttgttgcatgtcttaaaacaaaatagggcttcgttcgccctctggacatatgaaaccccaattctttataagatacaatcatttagttatgtagaaacaggaagtagaaaaataatttcgaatatatcgaatagaactaagtattaataagtaaaccggaggcaggaataataaataataaagtaaacagctgccagggttagtaatatttctagtcaacacatagcagctattagagataaacaagtcaaccattattagggaagtacagtcgatctaatcggaccatacggttgtttcactcattccctacgcttgaagcaatgttttcaagcgtccgaaaccttgttttcacggctttgaaactttagtttcaagccgatggaactttagttccaagctggagaaacaaaagtttcaagcgggagaaactaaaaagctctgtatagaccaaccaacagcccataagtaaccattgacaacaaggcagtgtgacagcaaaatttgccgtcacactgccatcacctactgttgtcacctcattaatcactcatattcaaattattacccccaataacgtgacagatgacagcaaattatagttttttattttcatagagagcttggctgacacgtaagtaggggttgactgaaaagtcggtagtatctctattctcctccttctggaaggaggagtggtcgcagaccgaggtggtaggataaataatgtttgttcctatttctttgtaaatgataggattatgtattcacctaccacctccccctacgggtactcctccttcgggaaggaggagatttaagatactattgactttttagtcagcgccaatagaggtagaaccgactttttagtcagtccccataagaatgttaatccaattgttgcggatggcagagttttttctttttcaaactttgttcttccccctatttcctcttcatttccctggtgcatccacctgggctcactcacctaacgcgcgtgcgaatataataatgtgcactcctttcctctgttcctcctccatccaagaattttatgttctacaacatccttataattcaacactttagcttctatcctcaaaaataattcaaaaaaagagtgatttaatattatttctaatattttccgattttatttcatatttacaatgaaataaatggcataatgcttgacttcgcctcttatatttcgtatatttgtaatgtcatagagaaacaaaataattattacttaaaccttaactttttaaatttatgaatgtttcagtagaacgctatcagcgaagaaagtacgtaagtcaggagaattccccgatgctgtattacgtacgtcagaaatcgggtacagtaagagtgatggacgtcgaaaaactggcagatgccatcgaagccaactcttcactcacagcaggagatgtaaaacatgccatcgaagcttttgtagagcaactccgcctgtcactcacccaaggtgacaaagtgaagatcgacggtctgggtacgtttcacatcacactgtgcagcgaggggacagagaaggaaaaagattgcacggtccgaagcatccgcaaggtgaatgtccggtttgtagcggataaagcactgcatctggtgaacgcaagtcacaccagcacacgaagcgaaaacaacgtggaattcgtactagcaagcaaaggtgacacggaaggcggaaatgccggcggaggaaacaccggaggcggaggaaatagcggaggcggaggaaacagcggaggcgatgaagaagctccggacccgacagtttaacaggacttttttgggaaagagcagtacaaaacactggagcagccctcccaattgaaactgactaagaagtcaatagtatctcaattcccctccctttgggaaggaggggtggctgaaagccggggtggtaggtaaaacaaggtttattcctattctattgtaaataacagagttatgcattcacctaccacctccccctacggggactcctccttcccgaaggaggagaagtaagatactaccgacttttagtcagtctcaggttcgtcgcttcgctcagaatgagagatactatatcgaactaaccttaatgtacaactccccccctgtatctcctttgcaatcatagagatgtgaggttcaattcccaataggtgaattgcttttagattatcctcataatcaattaataagtgcacatcatagtaccctaatttataattgcttaaaacaaatcccattttataaaaattatcaaattcctttttatctcttggcttatattcaacgccatgctccaaacatttctgcttgaaattgataataaatgtttgtaaacgattcatactctcattcatttacgattatagttacttcaaatcagttaattttactaattcgtcaccagtattaagccataaggcataagaaaatctattaatagtttgggaagcacagaattgataatattcttgcatttgtttctcattaaagaagtgacaagcatccataatgtgcatagcggcatcaatataggtgtacatatccgtatctataagcctataatattgccttatatgcttttggcatgaattaaatattgcatccaaaatagtcatggcagttacatctccttgcttctcatttaagaaagtaacttgctgactaatatctgttataaattcttgggtattggtatgcggtatgccaattaatatattttgttgtggcagaaagtctggatgtctgaaacgtgatgttatgacactgtctattacatttccctcttccagattgattattatgtcacttccttttaaagttaccattaatttgcgatacataattccatttatttatgtttgtcctatttattctttatgtaggcatataagaagaaacctgcaataacaagtatgactattatatgtaatgccacactaccgttactgttaaaatctgcatagtctgacatcctacctctgcttaataaaattatcaatgaatacataatcttaaattttaatagttctgtatgttagttgctattcaacctttcatagtgaagggtatataatctaaataatccttgttaaaaggttgaatataattctgtggattcattctactatctgataatagaactgaataggtacattgatactccttcattaaaagcagcaatccataagttacctgacttatcttttactatttcactaaaaatattatttaacttagaagaaatatgagatatatcaacagtattaattatatttccaggacgtttttgaagtgcataaagtccctgtgtagatacaatccatatataaccatacttatcatcctgagttatgctaaaacaaccattcttatcccaatgttcattactttttatatctacatgactatacatcaaatcatctttctcctctggataaagtaaaaagattccgctttcccatgttaaaatccaatgttgcttcttattatcttgaaaaactttaaatggattatttaaatctccaatctgaggcatagcaataaatgaatctgtttttgaattatatcgatgtaatcccctttcccataaagttacccaaatattcttatctgcatcttcataaatagaattcacactagtaacaggcaaagtagaatcatatcttttgcaatatgagaaatcggcagaacaacgaaaaacagaagttaatgttccaacccatacccatccatcactatccactatcattgttcgaatctcttgatccttcaaatcattgtgtgtaactggtattatctgataagttcgtttatccagtatattaataccttttttagttcctataaatagatatccatttttattttccgcaatacaagtaatttcattattcgtcaaaagatccggtgatttcaatccagaacggaaaacaagtaatcgatagccatcataccgacacaaaccgtctttagttcctaaccacaaaaagccttcccggtcacaatgaacccgcaaaacagtacttgaaggcaaataattatttaacggaagcgtagataccgacatttgttgcgcaaaggcacacggaaataattgaataaaaaacagtactatataaaatttcagttgatgtttcatagtagaattaatataaagacgtatttcttgtgcaatattaaaataaagatagctatcactattcatactttaggatatttcttatttgataaatatactaaaacaggtagtttttatctgtattcacaaaatgataaaggcaaaacattcccttttaatgtaatcgttcattcctataaaaatgaatttgttgcattcggaaaagggaaggagttacgctcattaactcatataaaagacaaaaaggtccgagaaaaaatagaaagtctgggagataattctgcatgcttaattttttatgaacttgaataagaatagaaagcaatgaagcgggcattaaaaaagtttggttgggcattattgggacttttcatattgttccagatttatttttcagtcagagtatactggctggtatcttgtacgattccgacttattcaatgtctcccaccttggttggtggagattacatacttgtttctgtgcaaattcccggacgtagaatatacaagaaagatcctttacggccggaacattatcttattcatcgaaggaaaggagcacatggcgtgaagaagggagacgtggtagtattcaattttccatacgcaaaacagaatgagaaaatgattctgtgtgatgaagtgttttattgtaaacgttgtgtggcacttcctggagagatatatcaatggaggactaatgaaggaacaaaaactgtatatctgcctaaaataaatgatactatacgaattgatactactaactacagtgattactataaatgtattgaatatgaaacgggattacctgtgagagtatctgaagagggcaaggtgtatcttgcaaatactttactggaaagttactgtttccgacacgattactactttatgcggggagataatgtaaatgattcgtatgattcccgctattggggggtattacccgatgattttattttaggagtagggaaatgtatctggttttccagagatcctaagaccaaacagataagatggaatagaatatttaaaacaatataggatgatgatgaaatatataagattaataattccttgtattgtgcttgcttcggtattcgttgcatgttcatcagctgataaacggttggaataatatataactataggtttattatattaataaataattctcaatcttttcatctgactagatagtaatatttttaacagaagtatattgctgccatcgtcctgcagaatattctcaaataaaatagaaaccaatagtataattctcgagaaacgtcggcaaactgatttagtggagaaactcggcaataaaccaaccactatcattttgtatggtccgttctattcactagtctgatttttacctaacgatcgcgaattatattgggctcacttccttcttgccttctttgaccttctattgacatttaccttaattataagatgctctgttacttacattgccgataacgaaagcttgtttattttttattgtcatatagtaaaatagattatttacattgtcactacaaacatagtgttttactggaatacccccaaacccaaactaaaatatttttcattttcttcggagataatctttcttttgccaacattatgctgtttcttttactactctgactatacataatggatagtaagcatgtaaacaaaaatctttgatattctgctggggtgtattttttttctgaagcggacatttctgatagcgtttccatttcttttctaacagtcaattcctatctgaaaatatcttcttacgcataaacctgtatgctgttggtattcgaatgacctgtcattctgacgatgctctttatcgaaatataggaggccattagggttccgaaacagtaaacctaaaagcataaattaaagattaaacataattctaactgatacaatttatgtcatatagtagctttggctgtcttaaccactaaaacacaaaaaagcaaattttggaaaaggttcagttacttatttgttccttgttcttgaaagagaaataaaagtggaacaatcctctaaaaagatattttataaatccaatccgttactttgaaaaacacaaaactactgtaaaacaatatcacatagaatctgtaaccaacaaacttttagtataaatcaatactatgatatcttatttataaagccacatagttaaactactcaataaagatagagcaatatgatatagttgatttattattttaaataaaaacattatgaatatgaaaggtttattttatttagttgttactatggtagtaataattgcatgtacaaatgaagagtttgatgctaattcagaagttaagaaggaagaagttaaaacaaagattgcatcattagctgaaaaatatgatgtaaacgtcgatttctttgagattaatccttcagaaaagactgaaaatgagatgtcattagaagaaattgaagaattgtttcgtgatataaaacaacttagagaacaccctgttgaattaaagatgtataaggataaagaagaaaatggctgtatgttttattctactaaagagcagaaacctagtgtgccgcttgctaaaacacgtagtgaaatttattcattcagtgattggatttggaatcttacatggtttagtgtaactttgatcgaagataacaaaaatgtaacagtaatgacagatataacaggattatcagtttatacgtattctcaatcttatgcgagtggctatgtatcaggaaatgctatatcatttaatagtacggggaaaattaaggcaactataactcaggttgttggctttaaactttcttatgttattaattcttcagggacatacgataagagtgcgggaaagggaagtgttacagtttctgcatattaatgattattgagaataaaaattatgattatgcctccaatgttttttgaaattgtttatgttctgattttgttgattgggatattggtcgtgttgaaaagtcatcaacttactaaaccatataaatatttatgggtcattttggttttgttatttaatctgttaggcataattgcctttttgatatggaaacagtatcttaacaaaatgagcaatagtggatcgcatggaaatgtctgatttgatatataatatgaatcgggtaaacttttttctctatgctctttgtaaatccgggatggattgaatagaccattgaaattggttgtttttctttgatttagccaccgttattatgatggtggctaaatttcttatcttagataaagatacaggaggtgcggacatcgacgtgatcaagattcataatttcaaatttgccggcgccttcacattgcctgcggcagccgatggaacgggaagttggagttcgtctgatttagcatttccacacgcatttaccgtagtgaaaaacgcaaacatcacggtcaatagcaataccgaagctaccgatattaccacaaatactcctatgctgaatataccacaggagctgactgcttggaaagtttccgaaacagccaccaaaagcaagttggaggccgataatgcgaagcaatgttatctggagatcgcctgcaaaatccggcagtccggagcttatctgttgggttcagcaagcgaatacaaaacaatttatgttccgttcggagatacatgggaacagggcaagcgtcatatctacacgttgattttcggtggtggttatgatgatcagggagaggctgtgttgaatccgatccagtttgatgcagagacaacaggctgggttgatgcagataaagacgtaaacgtccaaccttaatccaaacgtttattaatatcgtacccgttggcaggttaaacatacgcaagattaaccctgccaacgggttttttatagggaatcgcattttcaatatactttttgatgtgtaggggtgctttttgcgtacctttttcctggagaatttcttttgtggagtgtttgccctgtatattcccgatacgctgttatagcagggaactgtttttatccaagtagtcagatatagcctcttgcaataccgattttagcgaatcgcctttgcggatcgcgatcagctttaagttctggtgataggtttcgtccatgacaaaattacaatgcacggttttcgctttcttcggcttttgagcctctttttgcccggccgtggattggatcaggctgtctaatcccccggtcagcccggccgacatactgttttttaaatcgttcttctttgccatatggttactttatttctgttagcagttcgttacatacaccctcgtagtcctctgccccggcagatttgggggcatagtgaaaaatatcctgcccttgtgtcggggcttcggccagcgcaatggagttgcgtacatgggtgctgaacataataggtttgcaaaccaaactgtaatataacatatttatttttttgcaaaaattctttcttggagatcctaatcttaggaataaaaactccatgatgaacaatactgataatatcaggaacaaaatcaaattctttgattacttccattttagatgactccgtatgaacaatgatgttatctatattcctgcaagtatcacgaaacctcttcttatatttttgttttccgctatcgctcatacttttcacaccatgaggataaatattgtgtatcgttaaaataaccttcgtttgaggtgatagtacatgtagcaaataaagaatatatttttctataccaactacttcaacaaaaggtaaccattggaaatgaatagtatcaattttcttaaaagcaacatgtaaaagcaagtaaatgtaattaatccctccctccaatgcctttattaatctctttacaataaattcagtttgactgaatttattagggattagtctaattaaaccatgaccaggaatcaaaagttgtattgatgatttttcattcgacaattctttttctaatgcttggtataaagccttgtcataattatcgacctttcccgacaaatcaactaacaaatatttcatatttatttaaaccataggcgatcgcctaacttatatttcatattatcttttcgccgtccaataatcttagaaggtaccccgctataaccaaaggaggaacatctcttgttacaaccatgccacatgcaacaactgcgcctcttcctattgttacacttggcaaaattgttattcttgaagcaatccatacataatcttcgatagtaacgttactcgcgacaggagtttaatcagaactattataatcatttcacgccggtcaaacccaagaatatttactatatcaacattatcactgattgtaaaatcgctcgtccatcaagtacacgttatttgtaaatattgcaatttctatcaattgtaatacgttgcagacttcaaatgtctacattcctgaatataaaacttagcatgtcggatttcttcataaaacatttgcaacatagtcgtttcagcatatgacacggtgtccatatttttatttcaataaagaaatgtatcataaatactagatatttgaattgatctttttttatcccaaatcaccgtacttttattactaattgacataaataaataatctgaagaagattcaatagcagtgattccccaacctatattattttttttcaatgtttcaatcaattcaaaaaagcccaagtctttatgttcttctataaaactctcacttggctcattttccggcatatttagataatatctagacataattttcccctcctcatatacaaaaagctcattcgataaaactgatataaagaaatattgatcatctaataacgctattggataatgcaaaaaagaataatgtacattttgggttgccattttttttgcttttaataatgtttcgccaattaataagttattcttgattctaaatgtactgtattcacttttgcttagagaataatcattggataacggataatacgcaataagctctccttcaccacacatcatagcagattcaatgttagcatctttggcatttaattgaattgtattagagtaagttccaatatagctatactgcaaaatctttctcgctgaattacagataagacatactaacttattatcacgatctaaatagaaattatccgaataaacatattcatcaggccctattcctctatgacttatttcattaataaaatgtccttcttcatcaaaaacaaataatcctctagaatcttttacaaagtaaaaatttccatcattctttatacattcaatatcactcaacaagcattcacttgtttccaaaggaatatatttgatactatctacaatgtcatacaagtcgatttgtataggacaatctttattcaaaatatcaatgatttcaatgccatctttatgacatgaaacctgtcgttgacaggatgacatagttagaaaaattatcataataactcttcccacatgtaccaatcctatcaacgaactattatttctaccaatcatcactaatttgatataatatttctcacttcaccaattctactattaagacaacagttacctggagaatctttgtcacaatttcctaattcataagttaatgctaaatcggaaataggcttcgcattaactagagaaaagaatacaccatatcctctatttttttcttgtactacttgtattgtttatcaatatttcaaagaacatcttgctttcgttttaaaagcgggtgcaaaggtaagaggttttattttaactaccaaatgttttcggaagtttttttttcgcttttctttttctatcgtttctcagactctcttagcgaaagggaaagaaggtaaagaagaaaaacaaaacgacttttctttgcgaatcggactgcaaagataagaacttttagctttatcttccaaactttatcggaagtttttttgttcttatggtcaagcagtactgcgcttttacactaagtcaatttaacaaggctttcttctcttggaaagcgggtgcaaaagtacgcccttttcaaatatactccaaacttaaatcactctttttttgaattatttttgaggatagaagctaaagtgttgagttataaggatgttgtagaacatattttttcggatacaggaggaaaggcggaaaggggtacaccttattatattcacacgcgcgttagaagggcgaggacacgggcgtatgcacaagggaaaggaagaggaaatacaggaaaggtgaagaagatgcacaaaggaaaccagaacgggaatccaaagaaaagaaaaaaaggacggaggaaaaggggattgaaagactgaaaaggaagaaggcaggaagaaggggaaatcgtagcaagggaggaaaatacgaaaaaaagggtagagacaggagtcttttaaagttctacactcttggaaaaagaaaaaaactctgccatccgcaacaattcgattaacattcttagggggactttttagtcaacccctacttacgtgtcagccaggctctctatgaaaataaaaactataatttgctgtcatctgtcacgttgtcgggtgtaattgattgaatatgaataattaatgaggtggtggcagtaggtgacggcagtgtgacggcaaattttgctgtcacactgccttgttgtcaatggttacttatgggctgttggttggtctgtagtgtactgaataagttgacacttcaaaaatcgaaaataaagatgaaatattcgaaaaagaagtacaactattacagtgatgatgaacgaatgtcttatattcgtgagtatttatcaagtccagggtacgacgcgtacttcgttaactgtacgtttggtgaatattattaatcaaacaataaaagctaatttatttattgacgaatctgtattagatgcttataataagaagaatgaaactaattataaaatgcctcctaaagaatatatatcatttcctgaatcagtgacaattgaagcaggttctgtaagtgcagatcctgtgaatgttgatattaaaagttttgaagctgaaggcggtgctcaatatgcaattcccatcagtattaagaatgtggaaggaggtattgagaagtcggaatcctcttccagttttttattggttcttgtgaagcctttgaaacaagctgttcctaaattaacatggtataatggtatgcatgcagccccggaaggagcttgggggttagctttgccaaattatacattggaatggtggagtaaagtcacctctaaatcagggaacggtggatatactaagaataatcaggctataataaactcaggaggtttagggacagaactatatatacggtttggtgacttaatctattccgagaatggtagctataaaaataatttcctacaagtaaaaacgatggggtctcaatttgatacaggtgatccaactaagggaaaaggtttagaagcacaaaaatggtatcattttgcagtgagttatgatgcagcatccggtactactttattgtaccaaaatggtactgtagttgcctcattatcttcttcaataggacaaccgatgaatattgatcaatttcagatgatttcttcaggagaagaatattttccggatttctgtgaaatgtgtcaggttcgtttttggaaagttacacgcacagttaatcagataaagaaatctatgtataccgaagttgattatacagacaagaatttgttgttgtatctgccaatgaatgaaggtgaaggagctacaatactacacgatgtaaccggtaatggtcatgatgtggaaattggcaattctaacctaggtaacgaaaaccgtcaaaaggtgacatgggaaacatattcatttgctcaataatttaaaacagtatgatatgaaagcattatttaaatatatattatacagtacattttttgctatgtcattgccattagtcacagcatgtgaatatacactatcatgctgatatatactatcataccttatactatcacgaacattatattctgtctttacagattcaatcgggatatattgagtccgacatgaacagaaacatcctcccaatacaaaagatagcatcaatatacatactaaatgcctcataattcgatagttttcaaataattaagaatcccatcaatatgtatttgtataacttgttgctttccctcaggagataaaaggaattcgacatcttccttattatcctgaaaaaaattctcggttaatactgacggacaaattgtatcccggcatatggcgagattttgtgtccaaaacagttgtcctggcattggctgacggacaaaaacagattgcataatagcagattcagctaaacttgtagccaaacatttactattggcagaagcattattcgaaacaaatacactccatccatgcgcagataaccaatcaataccaagagctgctgcattgcaatggatagaaattaagatcgcatttcctccagattcctgataaattttgttcactcgcctacatcgtatagagagtggtatatctacatcctccttcacaatacgttctgcctcctctcccctatgacgtaatccggctaccactctatcagctatttctcttgtatatgcccattcttttaatctcccatccggtgaacatttgccaggagtattttcaccatgcccgttatctatcaatattttcatgttacaatattcttttttattaataaccacttggaggttgccgcctgtcacatttacgaatatcacaacgcctcatttcagcctccttctgttttaattcaattccatgtcttttgtaaatttcatctaaatgggcagcttgctcctgacggagttcaacatagatagtatcaatctttgcatctctttgagcgatacgttcctccaaccaagctatttgcttacgctcattttcattctccatgctgtcagcagccgcaccttccttacgtgcattagttttcctgttcacatagaagtttattacccatttgattgcttctaatccgcctagagcgccaatcagagctagccattcatttaatcccatatttatccaattttattctgttattaatgatgttaatggatatatcctatagtatactgtactcaaacatattcctataaatccataatcctttatctataaataaaaaacccagaaccaaaagtgcagcactgcttaaacctgacgcaagaccatcaatcccatcaataagatttattgcatttgttataaaaataacagttaatatagtaaaaggaattccaaaccaagcagataactgatagataccaaacaaaccataaaaatcatttatccaaagccccgatataggaaataaacatgcgcaaataagctgaatcataaacttttgacgatatcgaactccaacaagatcatccgcaatacctgttagatataaaagaaccattccacaaatcaagactaaaaattcaggtaaaatatatgtagcaaataatatagaaataccatatcccgtcaaagcacgaagtgcaagaaccacactacaagagagcaaaattgttgggaaaaacgaaactcctcctaaccgtggaattgcacgtttatgcacttttctctcatctggaatatcaaatagttttttccgaaaggaaattaacagaatgcgtggaattatcagtctagctacacaaacggaaattacaaaagctattataataaataaaatattcatatcagtgtaaattgcctttatacatttttcaaattatcaagaatccttttatttattatcttccgatctaaatcccaaacccatccccacttattaaaatatttaacaacagaactaagatgatatcttaatagccttcgatttttatatgaacctttagcatattcatgataaacgaccacatttgggtaatacatagttcgtgataccttcccaatacgacgacataaatctaaatcttctgcatacataaaataacgttcatcaaaccctccgaccttctttaacacagcaattctcacaaacataaagcaacctgataacgatggaacttccatttctcgactataatttgtaaagcgaagttcatatttttcatttttcttttctacatatcttctccatggaagaaaacgacgaaataataaatcaaagggagttggtaataatttacataaatattgtagttctccatttggataaagtaccctaggcattactaaacctacttctgaatatttattcatgtaaataattaatttttcaataactccttcctcaaaataaatatcaggattcaccactatatgataagtggcccctatatctattgattctcgaatagcaatattatgccctgcaccataccctaataataccatttttgagaaacttgattttaagacaacaagtatcgaaagtgaaataattgaagatggacaaattattctaacaacattaaaagataaagggaagacaattttttggataaaagaaaaaaatgaattttatccggagattaaacatgcaaagtgttacctatattatctaaatccatactctaaggctttctttacaaaacaaacgggggtaagacctgtagaatatggctcaatatacttgtttttgaatggtttccgcattcccccatatggcgaggagagtgacgattggctaaatttagaacagaggcgagcgcaaggttatgctagatttcttagttcaagagatattgttggacggatagaagttctagattcagaaaattcattccaaataatatcaagtcgagagggattagttagaaatgaaagtttttcaaaattaacaaatcgcgaaggctatttttataaatctttcaagaggttagaaaaatatgttgttgatggtttaaattgggatagcattccagaagaagataaagataaaataagggatattgagaaaaaaataatttcgggtcagttaaaagaaagtgaattaacctttcgtgaagatgaagttataaaaagaaggcgtatttattccagtattcattctattattggagcaaaagctagcgatgttattgagctttatattaatgaagatttaatacttgataaaatcgaagaagagaaggctaacgcagaacgagaatttgaacaacttattactgattttgaaaaaaagaaaatagatgctgataccctaaatcggattttgcaaaaaaaagccattgaaaataaagacttagaaaaacaaatagccgatttctcgaaatattctacaaatgaagctactgctaaagccattgcggaactccaatactacaaaaatacaatagaaaagcaaacacgaataattgaagaattaaaacttcaattggagcgagaaaaagaaattaatgagaaacatcagcaagaactagaaaaacttcaagcggaaaaacttcaagcggaaaaaacagcagaagaagaaacgaaaaaacgtgttgatgccgaaaaggaaaaagaagagattgaaaagaaaaaagagaaagagattcaattagaaaaattgaaagtcgaattttataaaaagcaatcaactccggaaacagatgctttaatacatcatgtgaaaaataataatcaaaaaataaaagaaacaatttcactatagataatttagaacctaatccgttgttaggtggaattagtcgtgttatttcatgtcttgcttcttctttaaaagaaaattatggatttgtggtttctcatgcagctgagaaatttgacaagcataagcaaactgaattggatataatattgaaagatgatcagtcatatattccaatattacgtcaatttttgattaataaagatattgatattattgtaaacatgcgacccacttattgcgttggtattataaataaggctaaagcagatttaaaatgtaaatatataatagagtatcatagtacacctttttatgctagaaaagataaaaagtttgcttttaagcgtttgttacgatatgatatcaagcaagagcctttcagatactcaataaaattattattatttccgttgtggtatcatttatcatatttgagagtgtcgaagttgtggaaaagaaattatataaatgcagataagtatattcttttatcaaataattatattgatgattttgtaaatgaatttaatataatagatgcttcgaaattgttagctattaataatccattgtcatataaagaatttcttcctattagtagacttcaaaacaagcagaagagagttcttatcgtttcacgcctatggaattataagagaattgatatgtcacttgaaatttggaaattgatagaagaacaagttggagattgggaacttcgtataataggagatggtccagaagaggaatatctgagaagactcgtttgtcgatataatctgaaaagagttgtttttgttggaaatacagaacctaaagaggaatatgagaaggcttctctttttatcagtaactcagcaattgatggatggatgattacattgacggaggcgcaacagatgggaactgttcccttggttatggattcttataaagctgtgtaccagataataacaaatcatgaggatgggattattattcaaaataataatgttgatgagtttgctatacaattgctcaccctaatgaaaaatgatgtaaaacgtgaagaaatggcaaaggcggctattaaaaatagtaagcgttttgcagtggagaatattgttgctcaatgggtagaattatttcaagaactaactttaaataaataaaatgaaagctgtgatattagcaggcgggtatggtactcggttaagtgaggcaactaatctgattcctaagccaatggtggaaattggaggaaaacccattctatggcatataatgaagatatatagccattgctgtcccattaaaatctaaaagagttctttgaaatatttgaaatttagttagttacagcgattttccgagcgaacggacttgaatttgtagctttgcatcagattaatccgatggcatatgttccaagacaaatacgttttcgctcaattggcttcatttctgaatcgaagtaagtttaaccgcatagtcaccaagtatgatggtgataaatatgtgaagcacttcacctgctggaatcaactacttgctttgatgtttggtcaactttctaatcgtgaaagtctgcgagatttgatagttgctcttgaagctcatcattccaaatgttatcatttaggaatgggtaaaaatgtatcaaagtcatcgctggcaagagcaaatcaagatagagactatcacatctttgaagaatatgcttactacctggttagcgaagcacgacaaaagtgtgctaatcatattttcaaacttggcggtaacgtttatgctttcgattcgacaactattgacctgtgcctttcagtcttttggtgggcaaaattccgcaaaaagaaaggtggtatcaaagtgcatacattatatgatgtggaaacacagattcctgcattctttcatatcacggaagcatccgtacacgattctaaagttatgattgaaattccttatgaaccaagctcttattacatctttgaccgcggttataacaacttcaaaatgctgtataaaattcatcaaattgaagcctactttgttgtcagagcaaaaaagaatcttcaatacaaatccatccaatggaaacgtagactgcctaagaatgtgctttcagacgcaagtgtacttctgacaggattctatcctaaacaatattacccaaagccacttagactggttaaatattgggatgaagaacaagaacgagaatttacattcataaccaatgcgatgcatatatctgcgcttcaagttgctgaactttataaaaatcgctggcaggtagagctgtttttcaaatggctcaagcagcaccttaaaatcaaaagattttggggaactacagagaatgctgttcgaatacagatatatgctgctatatgcgcttactgtttggtggcaatcattcaacacgatatgcaactggacagaagtacatatgaagtgttacaaatactgagcatctcattgactgataagactcatctgagagacctctttgataaaactaaatttcaaaatgacaaagaacgattcggaccaaatgggccaagtttatttaatttttaattcgtcccaattttaatgggacactaatgtataaaaccagtaaaaataaatacgagcttaggatttgatttgtaccctatgctaagaacacaaagttggttagaagcgtcgaaagatggaattctcgcttatcgtgaaagtcgggctcaggaattagtagaagccttgtgggtatcaccactgagtgtttggcacaatcgcataaatatgattggagaaagtggaggtccctctatgtctcaagcagcttttgttagaacttttataaattctttttttagacaaacaaaaggactgtattcatctaatctagtaaaaaccgagttacaagttctcaattggaatagagcacagcaggcagcttttattttcttgatatgggagagtatagaaaactctttatcaaacaatagtgatttacattgggctaataaactaagagaaataaaccattcagatgaaatcgagtatgatcaagcatttgtgagtaaagaatcttttttatctagagatcaaggggttcgtgctgtcatggtatatgctaatgattttttctatactttaatggatgaatctattttcaatttgaatgtatttttatgggaggcaggcatagatgacttgtctattaatgatgaatcacttcaaatggcaatacagttatttaagagaaatgagttgtttatgaattatttgcaccagttcgctgaacttgttgtaaaaatagattggagaacgcctagtgctccttttgacagagaagaagacagaagaaatcaattgatatataaaggtagtggaggatatacggaatttcaaaaagctttgaaagctgttttcgaagcagaaacaagtgatttattgaaggaagttgtatcaaaaatgagttagagatgccgataaatagattaattaataatgctgatattgaaaaggtttctgaaggtctcttatcggtaaaaaataattgtttcattaataagatgcttctgtcaccaacaaatccattattatgtaataatcctggaggaataataaaaaatcaagtgggtttatctgctgattcgttaaaagaatatatgtctgtttgtacgtttgtgcatacaattgatggttggtcttatttaagtaatgcgattaatgcttttttaaatggtgagccttcaataacagtacatctatcatattatgcagaactaagggctgctatggctttcttatgtacagaagggatactgatagcaaacaatgagcaagcgtgtatagatagttctaataatatatatatacctagttgtcagccaaaaagtatgcgaataactcgaacaggaacacactctgcgacatataaagaattttatatttatcatgagccaactgatacctatattccatattgagaacaacaattatgaaaaatagaattatatcacttttcatatatttattgcctagtttaatctatgctcaaaataatgcagacgacaaatatgagattctgtctctaactgacatgtttagtcttttcaaagatagtaaaaatagtgttcctcaagattatgacgaaatatatgttcccggttacttctatgagccttcttttatgtatccttcacctttaaagaaagaattttgttgtgtagctcaatggagaatcccaaacagaaactgtaagtatctatttttagaagatatatttccgcaaaacaaagattccttaaaacaagcttctcttgaattacaaaaaataaaagagaaatatggaatgagagaatcagctatgtatcaagatgtgcccgcaggttataatggtataattgccaaatggttcactggtagattattcgttttgcattgcccaagaaagctatttaatacagttgtatcaaagaaagcttcactcatatccattcataaaggtaggatatctgacgaaaaacaaataactccagatgagggtaagtttgaatcttcttgttttccacaaaaaggaggcatgatattaatacgcgaagacggatgttggtatgatgacattaaaaggaatatagattttttaatctctcccctaattaatgaaaattttcctacagaatttagcaaacatgttgggagggaatattcatttctattggaagtagtccctaaaacaggacaaattattccacacctcttattgccgaaaacattatctaccgacgagaaaatgattgtatcttatttagaaaaacaaataaggaagtttcctgaaaacagttttggccccctgataaccattgacaagaaaatgttatatggtcgatatttaaaatttattgtaaaagatgaaaagtttaagattgaagactaccttgaatattgatattaagtcaagaaacaatactaagtcactgatttcgaacactgcttattgaaattgccacaaagaaggactacaaccattctgccatagtacaattcaatattgaagatttccctattaaagcgagttaatataaacgaagtatgaaaaataattttttggtgaactttatattattacatggatattcattagacaactctagtctgatgtttggtaaaatggggtattctttaattcttttcgaatattctcactattttaaggatgctttagctgaaaaacatgcttttgagttattgcaagaggtaccactttctgataaagcaagaaatgccatgagaataacgcatgtatagattccgtgtttcataattgttcgtttctgtgaacaaatatagaagttataatataaactaaatcatactagcagaacaaaaaacagaacatggaaggttctgtgaaacgattggaacgaatttgcaagtttaggagcagataaggaggaaacaatagacacaccaaggcattatataaagaaaaaatgcacagaaaatcgagtataaccgatcatctgtgcatttactacttctcaataagcctttcccgctctgactaatatctaaaaggaaagtacaaaagacttatacagtcgggtccggggcttcttcgtcatctttgcctccgtccccaccgggattaggtttctcactgccgctaccattgttactacttccgtccgtatagtccgtatccaactccgcacgacgggtaatactcatatcatccaacgtggtcttgaatatttttccaggatagaaaaggatctttctttggacgattgacttagatgatacttccttctcgtcatccgcactcttagcgcgaatggtagggctgaagatgccgaactcacccatctgaacgctctttccgtcgtcaatgtcctccgccatcatatcgacaagaccgctgacgaccagatccactaccttgcggtgaactccacaaagacggctcaccttgccacacatcttggaaaaacttactctgccggaacgaaccgactttgctacatacttttcgtttttgtccttgtcaaaaccgaacactctttttgttactacatactctaaagccataattgttaaagtttaaatggttaaaaaaataaaggttatctgtttgccattccgttttgtctgaatgactctgcaaagatataacagggcgcaaaccgtccagtcccctttagtcccccttgtgtctcctttcaatggctttaaagcagtaaatatcctaaagtaattcgcttattttcaatcgactatacagatgaatattttttttcgaaagtgcgttcattgctgtttctcccaatagagtctgtcggtttccagtctccatataccgacatacccccgcccgcaatcagtagagaaggagcgcttcgaaatacaattctttacctgcttactcagagtctcactatctcccaatggtcaagtaagcatttccaatgtatctttacctatgacgagatattctcctctttgatctgttgccttaacctgtatgcagatgccaacatacaaaaagataataaatagaaaagtgtgctttctcatagctttataattttagaaaaccgaatatacatatatataatagcaatgagatttttctataattcatcatattatcgtatactcatttattttatgcctatgcaataaacacaaaaagtagcgttgtgcatacaatttgcatgcaccattcaaatttacattttattatcgaaattagtcagtagtcgagcatttctaatcctctcttccttttcaaaacatgctaaataattctcagtaacagttaaattagagtgaccaagactttctgaaatataagacgttttggctccaccacgttttagtactgtcgcaaatgaatgtcttgccgtataagtagtcagttgagcaatacctgtaccttgggctattttttttaattttctattacatttagtaacgatacgacgcactaatttgatcttttcaaaagcatcttcattccctttggcatatttaaaaatataggtttgtgggcttatattagggtttccccacttatgaatgatatcccacatctcaggagttatagtagcacgtatttctttactatgtttagtagtcctggatgttttggaacgtataaaacagatttctccatctacaatatttgagtactggagaaataacagatccataaaattaattccattacataaataagagaagaaccataaatcacgaaattcctctaattcattggtagaatcctggaaagacatgactctttttatctcaggaagagtgagagccagctttcgaccatgtccttctggtatttcatatttattctttccaaaaggaaatgatgattctttcagtattccatctcgtactgcacggtttaatatgcactttaaggttcgaaaataaatactcacacttgaatagctcttaccgttagaaatccaaaaccgctcacagtgcttcagccactccacagtaattctgtctaatggaatattggtaccaccaaaacattctaaactcttcaaagcacttcgataatttaaatatgtacttgcctgctcattatcctctaattccttcatctttaattcgaaagctgtacgcagattgatttctttcgtatgccttccaagtctgatactcaatatttcaaaactaaattctcctttttggataagttcgctaacttgttgttttataatagaaaaactactttcgatatcagtccttacctccattaataactgactttttgcctttaacaatctatcccagtcttcttttgacaattctttccccgtagaataatatttctgctttctcctaaatacgacttgaactttaactggaaataatccattaattttagcccttctggtgtctaatatggtcaatacagaaactccatcttttgaatatttgaacataaaatgattctttatatcatatatcctggaatggactggctcttgtatgcactccatgctcctaaccttgcaataatccatgctgcccatgccattgattcttttttatatggattttgctgtatttttgtatttccctcactcttttttcctactatatgtaataatgctatttctttgcttgtaaagtagatttctgaagagagtttttcatcttctttatcaaaagaaagtttgagtaccatcacctgcagggctgcctgcaaggaaattaagattagtttttgtaatgccgaaactgtttccaactgtgcgtcctcaatcatgaatccctttcttttgagcactctgaacaactcttcaatcagccatctacaacgataccaaccgatacattcaattgcttgttctacagtctccaccacatgtgtagttagcagtctccattcaatagggctctcatttaccggtgtactggaagatttttctttaacatgtatgcaataaagactaacagggggactgccctttgccggaccgttaacaggagcgcacaaggtgactctttcaaagcgaagttccatgcacgctacccgtttcttacgtccgcttcccgggagcacttcaaagctatactctgcccgtagaacagcctgctccattaatgtattcagatggacagaacagtctggatcatccaaccggcaattcctttcatgaacagaacgtatcagcaagtgaacattatcagtagggatacggctgaaaagctcgaaaatgtccgcttcacggtcaccgatgatcgttttaactgcatcccggggcatttgctcactggcagccattccactttctatccaacgatatgactctttttcttctataggctgatatctgtaattacgttcttcacgacttaaagcagccggtgagcgattccactgcttaaccgaagaaaagcctataggaatatgactggaggcatccactaccaagacaggatgcaaaaaagtaccacattgcttttgaccgacaatgccgggactggctgtttttttcttcattcgctcaacatgagcctcatagtttatctccgaggtatcttgaatacacagtaaatgctgacgaccggaagcattcttacagcaagtgtgtatcagacctgataagatagcatcagagctgactgaggaattgttcaaaaatctataagcacccatcttttctttatgttccttactaaattgattcactatagcactttgatggacaaccatctgagagcaaattaagtttaaacgccgcaaaagccgaggatcacgaatttgatctgtctctaataacatcaagcaaagataaaaaaaataatatatacttgtgtataaagggtagcttcacatttacatttgcagtattaaatatcacaacaaaatataagtgtatatttgaaaagtagagttgcagtgaactaactttgacactagtcttaaatgactataggctgaatcagactgcaactctcttaataggagaacctagccagttagaattgtaggctcacgacctaataaatgtattagctgtttctccttcatgtttaatactgtaaatacaaagttatgaattattctcattttgtaggtcttgatgtaggaaaaaaaactttcgatgcatcattaatgtccgcagacgaaaaagagttgtctcacaagtcttttgataacactccaactgggatccaatctttattggattggatagctggttatcatctctctttatccaaactcttgttctgtgctgaaaacatgggaagttatgtcacagagttatctgtttccagtgtctccatgggattttccctggctttggtttgcccgttgaccatcaagaagtccataggcttgcaacgaggcaaaaatgaccgcattgacgccaaaagaatagcgaactatgcggtattacactatcgaaaactggagttatacaaattgcctgacaaagacttggtgagactgcggggatggattattatacgtgacaatttggtcaagcaaaaagtatcaagcataaagttattggaaacattctcctggatggctaagttggctgatgtgacagaatccatttcttttttggaagagcagctcaagtcgataaaagaaagaatcctggaggtggaagaggatatggagcaactaatagccgccagtacatcgctttacacaaactacttgctattaagaagtataaaaggaataggaattatcaatgccattgtattactgtgtgttactgacaattttcaaagatttgacaacccgaggaaatttgcctgctattgtggggtcgccccatttgaacatacttcaggtatttccatacggggaaaaacgcagacttcttcattggctaacaaagaagtaaaagtataccttacccgggcagctattactgccatctcttgggatccgcagatgaaagcatactataaaaggaaaatagcagaggggaaacataaagcatctgtaatcaatgctgtaagagccaaaatcatagcaaggtcttttgctgtgatacgaaggcagactccatttgtaacattagccgtataataaaaaggtccttaacttcgaaaatatcttaggtttaggaagtagctatacacttctgaagagtaggtatgtctatatacaaacttacccaaggatacgttaatgttcgtaaacttgggtaagattttatagatattgtttggagaggacttagaattcatttcaaagatcaagtcgtaaaagatatatgtgtgaggaattggggtagtgatggagaattgaccgttgaacaggctgcagggataacaactattaatactaagttcaaagagaacttggaaattacaaactttgatgaatttcaatattttgtcaattataccaatagtaatggccgttatttggattctgctaataacaatcgtattgattcgagtccattccagaattgtataaatttgaaatctattgttcttccacccaacatttttaatatcgctctcagttttttggctaatactaaaatttctaaaattttaattcccaagtcagttggtctttgtgatgttgcaacgtttaagaattgtgtaaacctcacttctattgtgtttgaggatggaggggatgtaccattatacgtcggcggtgatctgtggctagaaaacactcaagttacaatattagtacttccatttaaaacatacagaattagaggatattggagaagaggctctaatctaaatacattatatgtaaaatcaacaattccaccaatattggaacacggatggggagataatcctgatacctgtgatctatacgttcctattggatgcaaggaagtttatgcttctgcgaccaattggggaagttttagaactattacagagtatgactttgatcttaaccccaataatgtacactaacaatcagagtagaaaattagtatcccataatcctagaagccaatgaagtccatccggaagcagacttgtaagcattaactgctgcttctgggacataaatagggaatgtagaattaccaaacacactgtattcaagagatggagggacatttcccttcaatttcacccctgctaaagaagtacatccattaaatgttgccatacctattatagtgacagtttcaggtacttctataagcgaagttaatgaaatacaatctctaaatacattacttggaaatttactgtcagcaaaaccctttggtatatttacactttccagcgaagtacagccataaaaaatattcgtacctaagaaatatacagaatcaggaaatagaacttttttaagactggagcaaccaccaaaagcacttgtttcaattcttttggctgtaggcattattgttactgattccagattggtacatcggtcgaaagctccgtatggcaccccaggctcaccaggatactctgtacgtgcgtttgcattagtgaaatatttcaactcattaaaagatgtaatttccaagttctctttgaacttagtattaatagttgttatccctgcagcctgttcaacggtcaattctccatcactaccccaattcctcacacatatatcttttacgacttgatctttgaaaatgaagaagtagcttaattttgcccccgaaaacaaaacatgtttttattttataacttaaaaagaaagaagatgaaaaagggtttattattggtagttgtaatgttagcaactatcgctgtaaaagcacaggacatttacgtaggcggatcattgaacgtatggcgtaacagcacaggcaacactacttcttttaaagttgctccggaaatcggctacaattttaatgaaacatgggcattgggtgctgaactgaactattcacacgaatatgtgaaacaagtgactgcaaattcagttactgttgctccgtacatccgttggtcttactatcagaatgatgctgtacgtctgttcctggacggaactgctgctattggtttcgtgaaaatcaaagatggtgataccactaaagcaggtcagatcggtttgagaccgggtatcgctgttaaactgaacgatcatttctcttttatcgccaagtatggtttcttgggatatcgtaagaatgtgaacacttccggagattctttcggtctgatgttgactagcgaagatttgtctattggtttccactacaatttctaatcgggtagtagataataaaaaataggaaaggggattctctgaaatagggaattccctttctttgtgtgtaatctctatattttacacgtttgttaacgaaaaagttgtttgatatatatatcaatcatatatttgcattgttaattaaacagatgatttaactatagtattaattaaaactttagaattatgaaaaagagtgctttatttattttatttgcgctgatttcagttgctggcttttcacagattacaggttggaatgctaaggtaggaatgaacattagtaattatacaggtgatgctgatttgaatgcaaagattggctttaaacttggaggtggttttgaatatgcttttgataatacttggtcattacagccatcattgtttttgtcgactaaaggagcaaaaaaggatggtaatagcataaatgcaatgtatttggaattaccagttatggctgctgctcgttttaatgttgcggataatacaaatattgtggttaatgctggtccttatttggcatgtggtattgctggtaaaaccaaaattgatttggggaatgatacggaacgtaagtatgatacatttggtgatgatgctttaaaacgttttgatgccggtcttggtgttggagtagctttggaattaggtaaggttattgtaggattggatggtcaatttggtttagtagatgtagaaaaaataggtaatcctaaaaatacaaacttttctattgtattaggatataaattctgataagaaaattactaaaaagtaaaccgctgtaaaagattacttacagcggtttctttatttatgattgtatataatgggagtgtaatttaaactctgtctggtttctatttcttttaaatcacaacaaatataattttttctttttggatttacaaatgcttcttaaggtagtttttggatgtgtgcaagggcggcgaagaatgagccgtttatatacccttgctcacatccgggaactaccttttctttgcgtttgaaaagcaaaaaaggggaaatgggttatatcgccagaggcattctctctccaaacttgattcgtagttgcccggcagttaacgcccaattctggagcggttgcgtccatttcttggagatgttcatcacagccaggtagatcaacttcatcaatgccatgtcattgggaaagacacccttggttttggtcacctttcgtacttgacggtggaagccctcgacggcgttagttgtgtaaatcagtcttcggatatgctcatcataagcaaaataggccgatagattatcccagtttcgtcgccatgattccaagacaacagggtattttttaccccatttatcttgtagtttatcaaggttgagctctgctaaatctttattaggggcttgatagactgttttcaaatctgccataaactctttttgatcttttgaggctatgtatttcaatgaattgcgaatctgatgtatgacgcagttctggatgattacctcaggaaaaatagtgctgattgcttcagcaaatcccgtgagattgtcaatgcaagcgatcagaacatctttcatgccacgtgctttcaggtcggtcaagacactcagccagaaattagccccttcgctttctgatacatacatgcctatcagttctttatggccatctttattgactgccagaacattatagacagctcgactttcggtacgaccaccatccttcaccttgtagtgcattgcgtcaagccacacaatggtatacattgattccagggggcggctttgccactccttcaccttgggaactatgcgttcaataatctcacttagggtgttgtgggagatctcaacatcatacatctcctcgatatgggaggaaatatccctaaggctcaaacccataccatacagactgataatcttggaagacatgttgtccgcaagaatcgtctcgcgctttttaaggatctcaggactaaagctgctgtgacgatcttgaggagtcacgatatcaatctcgccggccatggttttgacacgtttgctgccacgaccattccgcttattgcctttaagacgctctgaatcatcaaggtgggaggacatctcgccatctaaagcggcctctaaaaactcttttagcaacggaccaaaggctccgtctttgcccgtgagcgattcgccactacgcagttgagataacgctttgtcacgcatctgctgatactcttcactgtttctatccataatacaaagataattgtttggggacagagttcagattacgccctctattaatactagaacttatgctaaaattcaatgtttgatggcatgaatgcttttaatttttaattaattggtagaaataagctcatgttggactatggtttggtaaaaatgtatggtacaaaggcgaagtatttcaaccggtcggtaataaaccggtcggttaagaatacccccaaacgcttccccgggtctttatgtttgaaataacaaaggacgtatgagattctctaaggtgcaattttagtaccttttgaggttataaatgacttatcagaggataattgtaaagaatttgatagattatatcgccttttcgcagttggtggataagatgaggcgatcaaaaccatgtagacctataggcttctcaattccgaataaatatatgaagaaagaataactacggctaattactgcatgatctccgattgctccgttgattatttattaaccttaattggaaaccataaaaaagccatccccggaatagacgaagtagggatggctttttttgtagtgtgcttactattgttcggcagactatgttccgtgagtttttggaaaggttattccttgacaggctcagccggtttgtctttggatgcagtgtcagtaacgactgtatcgttgacaatagcggtcggtgcactcagttctgtcttaacaggttcctcgctcttggttacagtatcttttactactgtatcattaacgatagctgttgcattaacttctgccagggctgtcgcagcttctgcagagttctgagccttaacaaggaatgaaccaccacaaacaaacataaacattgctactactaatactaattttttcataatcgtttgctttaatgattattaaacatatattttcaattctctcttatgtgttaaggaatcggttgttacattatctaacggctaattaaagatcaaagtgtgtgccaaagactgatgtgtgctaacaatgcgttgattataagtgggatatgtagattatgtacattatctatagtgtggaaacgtatggggaatgtgtggaaaatggggcagggagtgtggaattattccacaatagtgtgctttgctatgcaggtaataataagtaatgaaagaatggttgtgatacaatgaacttatgtttaagtgacagtgagttgaaatgtagtaaataagtgaccgttctgctactgtttattagtcggtcatattgattctctaaccattataaccctgtttttatttcgttgcacctaggtttgatagtcgttgcacgtaggttgaatagttgaagcaccttagtgctatattcgttgcaccttggtgcaacgaaagaaaactgctgacttttgacacatttacatttgcagtattaaatatcacaacaaaatataagtgtatatttgaaaagtagagttgcagtgaactaactttgacactagtcttaaatgactataggctgaatcagacgttatatatttcttatactcaacacactattgaggtgttaccgtaaaactatcaataaataaggtactaccaggagcgcccataaagtagtctccttcagcacttgaggaacacacaatagctaaataatattttttagttgcatcataacttttcccttccaataatttaaatgggatagagaacttagtccaatcactcttcgctgttccatcttccaaaacggccttcattacaatacgtttagagcttccaatatatagatcaggatcattgtagtctccattcaacggaatgttgttattctcttcatccaaaagttcttcatacaaaactgcatatattgaacattcatctgttttatcagctacgacttcatttttattattataatatgttgtccctggagtatatttataatagccagtaaaagtagcaggttccccaacaaaaggaacaccaaactttgtactattcaaagtattattcatatcagttttaaagatacctgtaaataatgagcctgctgttacataaggtaccaaccctcctaataatgcattaaaatccataccatttaaaaacatgtaagtataaactgtttgcaatttagctgctttaccactttgtccttctacaggagaaactgtatatgagaacagctctggaagatttgaaccaaacatctcgttaattgtcataattcccggattactagtaccataaagtcctttaggaacatcatattgttctgtagaacccgatgtagatgatttgatagtctcccattcatcgaatccaaaatctcttatttgacctgatacagaaactgtatatttagtagttacaattccatcttcggaagtcactgtgtatattacaggagatgaaaaatcttgttctactccagaagcaggagttattgttgctttatcagaaataacaatagtaggcgcaaacgtcaagttctccaatccatctggaataataaaactaatattattcccatctattttcccctctacattcgcatctcctatcttaactacaaagctctggatcgcagcctctgaactttgatctgcagacagttttgttcctgcaaaatcaaccttcacattcaaagttccgccagcaacaacagctatattcattgccagtttatcaccttcaatagttccattcactgttacagcacattcaccaactaataatgtaatattctgactacctgcaaaagtataactattaccatttttttgtacagaaatctgttctactgcaatagtaccaagattcaatgtctgaaaactaaagtttctcagctccatcttaatttggttttcaccagtcttagaaatatatactttttgtgttatatcattaacttcaataactccagctgcatcaacatctaacttaccccaataaactccatcaatttcaccatcccgaatagtttctgggtcgtcatcactacaagccaaccaaattcatatagtcatctgtttttcaaaggaataagtaaatatattcttttgatcgcattgcaactttatactatttttcaaagatacaactaattcaagaaattacaataatctctcccactttatttccagtgttcataatgtcatgacattctgcataaacgtcactacaacactgaaaagatatcaaaaatacactatctttgccttcagtattctccatgagcaaactaccgcaaaaacacgtagcaaattagtgggataattcatgggatatgcttgaagcagaaaatataaagttttaaatatcagcgtggtaaatctgcaaggagaatcccaggcgaatcactaaaataagagagcaattcaaagttattttttgagttgctctttttcataacgcaagatgtacaatatcttaaaccaaggatgatggtaaaaagaataaagaggcatactcaatgtctacccgaaagcagcactataaggaagtaactttcctattataaagaatctaaaacaaatacaaatgtcgaaatcatacaataggaatcctatacgattgcttatatttgtactatcagatcgtttttcaacagataccctttctaaatatgtacaaagaatacttaccatgccatatacttgctccttacgttgataaatattgggaattcaaaggccaaacagaacaaggtatgcaaataaaactatctacagatggatgtacggactttatgtttatattagaaaacactgttaatcatggtattatcatgcagccttatcattcttattttgttggtcccatggatatctgttcggcattaataacattatcaggtactatcaatacatttggagttcgctttcgtccatgcggactatcccgttttatgaaaatttctctaagcgaattgacaaatataaggttaagtgtgaatgacttaaacactatttttagcgattcttttgctgaaaggttattcgaagaacagggcattcagtgcaagattaatttaatagaacgctatttgaaaaaacacctatataaaagcaaccatacaatggatacacaaatctcatacgctgtgaatcaaattaatgcgcatgaaggcaagatatccataagccatttaatggacgaagttaatctgtgccaacgacactttgaacgaaaattcaagttacatacaggtttcactcctcaaaaatataatagtatagtaaaattcaagaatgcgattaaaatattgaggaacgaatcattcgacaaccttttatcagtagcagtaaaagccggatattatgatgcttctcatttatcaagagaagtgaaaaagttatccggtagtactccaaatttctttttatcattaccacccgataatgagactactattatttatacaaaataaaaaagtcgaattcatccaatacccgtgtcttactatcctttatatttgcagcattaactaagtatatgtccaggatcatttgggtaataaccgtgtggttgtagaccagagtggtaatgttgaagaagtgaaccattattatccgtttggcggtctgctatcaagttcggtaagtaatgctgtgcagccttataagtataacggtaaggagctggataggaagaatggtcttgattggtatgattatggggcgcgtatgtatgatgctgcattgggtagatggcatgcggttgatccgatgagtgagaagtattatagttggagtccgtatacttattgtatgggtaatccgataaatcatattgacccggacggaaatacagtagttatttggtataataatgatgctgggaaaaaggtttcatattcatatagtggtggtgacataactcatccaaattcatttgtacaatctgtaattactgcttatcaatataataaagcgaatggattgaaggcaggaaacggaggtggagcctctacggtagcaattgtagagaataccaatataaaggtaaatgtgatggaagcggtgtttgagaactcatataatcccaatgccgcacgtggggctggaagtatttattggaagagtaactggggatcgcaaaaagataatggaatagtcaattctccggctaccgtatttgaccatgaagcagatcatgctttggaacataaaacaaatactcaagagtatgaagtaaatagagcacgaggtagcgattcgcaatatcagacaaaagaagaaaggcgggtgataactggttctgaacagaaaacctcaagggctaatggagaaacccgttccggtcaagttacaagaagaaaccataatgggaaaactgtaataacgaaaggcgttacttcaaatgtgattgatagacaaaaaacacaggaatatgagaaaaggaataaagctgtatggacttctgaaccataaaaaatgtttttatggtggttcattgtttttgctattactgtttataacatcatgtaaaagcaatcaatttttaattgatagtaacgaagtggaaaatgtaaatttttggtttataggagatgtggatacagatgttcctatcaccgattgtttgcacattgtatttggaaatgatagccataaaacaattattcgtgataggaagattatcaatcgctttttgactctggttaatcagttgaaacctgccaatcccgattcttatatcgatcttagggtaagttcacttataagattaaaaccgataaacggtgaaaggaggcctgatataaaagtctgcattggtgccggtggttacggagtgcttttaaatgacgtgttgatgaagggaaatccaaagcaacttcaaaagtttattcaggaagtattatatgattctcttaccccttatgaatggttaccgtcttttataaaagaatacttacgtgaccatccagatgaaatagatgaatatctacctaaatcaaaatagtgatagtgtatttattctgataatagttgtctatttgaaatttatgaaaatatttagaggatgtgttatcacatcctctattacaccttgtgataacgggcatagtgggaagttaccttataaaatacctaagacatgggcatggtgtagtcataattctatcttagatatatctggaggatcacaacctgcgaagagttattttgaaactatacctaaaccaaattacattagactttatcagattagagattatggagagtctcctgtacctgtttatatcccaattaatcttgcttcaaaacagaccgaaaaaggagatatattattagcacgttatggtggttctttaggaaaagtgtttcatgctaaacaaggggcttataatgtggcaatggtaaaggttatctttaaatttgaaaatctcatatacaaggagtatgcatactattattatttatctgacctatatcaaggaaaactaaaagaaatttcaaggacggctcaaacaggatttaatattacagactttaatgatatgtattttccactcccccctatcaacgagcaacaacgcatcgttcaaaagatagaagaacttttttcatcccttgataatattcaaaaatccttagaagtgtaattaattacacttctaaggatagataaaacttaccagtttactactttgtccacaattttttgctgttcactagctgttcgacggagataaatacgagtagtttcaatactttcatgtcccataaggtcagcaagtagagcaaggtcattgaatcggtcaaggaagttcttggcaaaacgatgacggaatgaatgaggataaaccacttccttattcattccgtattttcccgcaaaatgtttcagttgttgggctatgccacgtgttgtaatacgttccccaaatcggttcaggaatatatagccggaaataagacttttttctttgagccattttgtggcttctgtacgcaaatttttcggaatatataaacgacgtatttttccacctttactgtaaagatcaagatggccaacttgtacatgctcagctttgatgtgaagcaattcactgacacgtgcgcctgtggcagccataaaccatacgataaaataccactcattataaccatcagcttttaagcgtgtttttagaaatttgtagtctgcatcgctgattacgttttccaaaaagttcttctgctgtactttgacgaactttaccttcagtttctcctgttttgtaaattccaaatacttgttgataccttgcaatcgtaggtttaccgtttgcggtttaaagttctccaccagataccctttatatgttaaaaggttctttttgtttacttctccataatgattgaggaaatactgtactgtccacacatacgatgtaacagtgttttttgccaaattagttttggcgagatagcttttgaattttgttaccatattatattgatttataatgaatacggcaacaatataatagaatatatcgggcattatacgcagttgcctaatggatggactgttgcacctatgcaagtactatgctctttggttgatggtgataagcaaaaaggaatagaacgaataaatcttgatgtcaaatatttgcgtggtaaagtaagttttggtgtataccatacgtcatgcttacattattagccttttttttaggaagctgtgatgatggaaaagaagtatctcctattacaggtagtggaggaactccattcaatcctgcttttcctattcgtattgatagtatttaccctaaagcaggctctgcagggcaaagagtacttatttatggagagaattttggaaataatccttcccaattggaagtttatattggtggtcagaaaagctcggttgtaaatgtaaagtctacatatatgtattgtcttatgccatcaaaagcctatgaaggtgatatacaggttacgataaaagatggagaaaaaacatatacttctgaaaaatctgatgtgagatttgaatatcaacgattaaaagtagtaagtactttacttggtgaggttaatccacaaatttccgataaaaagaaaaattttgaaataaaagacgggccttttgataattgtggcggtgttgctaatccttgttttatgaaatgggatcctgagtaccctgagttgttatattttgctgaggatacatctgttgaccctgaaggtgttacaggttctggtatacgctgtattgatttcggacggcaacaattatatactattcttcctaggagtgagtatggagggtatgagcgtgggcgttctattgatttttttaaagataaggacggagtgtatcatatggttgtggctacatcacaagctaatgcaactaatcctgcggtctatatgtttgatcgtgtttcagatacaactaaaccatgtggttttaaatggtcaaatagaagaacaattgtgaattacaatggttgcgcatgtgcagcaatccatccccaaaacggtgatttatattttactcattttcagaaaggtcacctttatagagtaaaaaaagatattcttcaagaatttgttgacggaacccgtactacagctgtttcacctgggacaggggcggactatatgtttaccgtccaagataaagaatgggaatttaatataattattcatccaacaggaaattatgcttaccttatggttattaacaagcactatattcttcgttctgattataatggggagtcttttactactccttacgtggtagcaggaagcgctaatcaaaatggatatgtagatgctgttgggaatttagctaagttcgattcggcataccaaggtgtatttgtaaagaatgataattataaaggtgagatagatgaatatgacttttatattgcagataaacataaccatgctatccgaattttaactccactgggacaagtctcaacatttgcaggtcgaggaagcgctagtttaaattctaatccttgggggtatgttaatggggatttgagaaaagaagctcgtttcgaacgtcctaaagctattgcatatgatgaaaagacaggaatagtttatgtaggtgatgcttataatcaccgtatccgtaaaatagctttagaagaatttaatgattaacacactaaaatatgaaaaaattatttgtcttatgtactatgttgctatgggtggctataaacgccttggcacagcaaaagattagtgtctctggtacattattactgattaggttgtttgggcctgtttgaacgtacccaccataatttagtagctcctatatctccacctcccagcaatgttggaatttcagccatattaggattggaattataggctgtaggagcaaatctaaagcgttcaggaactctgcaatcttctattgaggcgccaattcttccaggagcagcttcatccataggtttcattaaatatgggaaaccggttctgcgatattcggtccaggcttccacagcgttcggatatagtgccagatatttttgcgtaataattttctgtaactgttcttcttgcttactcaaatttcctgtgtaatcatcccatttgggtgaagtatttccaatgcttaaatcatggttataagtgccatatttgtaattactaccagtgagtccggttggtttacctgttcctgacaggtatgtggcaactccactgactccttgctcttgaaatgaaatatttattccttgttcatagaacgttttggggtcaccacctatcaaattgtatagagcagcttctgctttcagaaaataagtttcggatgctctgaaccaatataaaggagaattggaatctactttcggacgcgatgcaaattttgcagaatatgaggtttccgatttagatttactattcgtcggtgcaaccggaaaataacctgtttgcgcccaactgccagaaccatatgttccttcagtaaaatatgcacttaacctagggtctttatatccatccaaatatccccaaatagtggcgcccattcttgtttcgttatattcattgacagatgctaacattgaattcagcaatggcattttatcagaacttttgatctttgcttcacttgaaatatcttcaataacaccgccatttttaggatctaatgctttcgtaatatattctttagccaaagtctcatctataaaatgtactctgacagctattctcaacattaatgagttagccagttttacccagttttgaacattgccattgtatatcaaatcgtactgagccatcacactataagatattgtattcagcaattctactgattttgacagatcagccagcatgcttctgtaaacaacttcctggctgtcgaattttggcgcaatacttccatcacctgctgagttataagcaataggaccgaaaacgtctgtagctcgcaaccatgctatatttctgacaatattagcaatctccaatatagcttgttctgatggggaatccgaatctttagcgatttcatatatttcattccagggcaaaaagatttgcgagtaaaagttctgatatgcataattcattctactatctgtaaaattccaattagcctcattattaaatccccaattattattattgccaaaataaccaatatagttaccggaagatatcaaatcagtattttgtaaatcatttccaggtccagttgtcaaactaggtgaacctatagggatcactctttgctgcatattcatgaaacgggcaccatatttaagaggacctaattccccatcggagacaccgtaaggattggtattgacagcttcataatcacaagctgacatagaacaaagtgccaaaagccctttatggtggaccaatgatgtcacgaagttgtatttaggtacatattctagaaagaaatatgaagagtttgtaaaatgcaccaatatctcagattttggaaaactaagtactgccgaaaaacggcaatatgcattgacattcaagtactacattgcagtaaacaatgtaatggataaaaatgatacaactggtgaggagtttccgatggctgtacctattaactaattagaatagcaattgaaatatgaaaataaagatattatttgttgtaatgttccttttgatcatcacgtcttgttatgaggataagggaaattatgattatagagaaatgaacgatatcgagatttctgtagagactgaaagttcttcgtatgcgttaggagataaagtgacatcaaaaccaaaattggttttcactttaggaaaagaatcctctgatttatcatatgaatggacgtttgatggacatgtcatagctgatactagagatctagagtgggtagctgatacaattgctagtactaaagaactgaggttggctgtaatggataataacacaggagttacctattttggttccacgtacatttctgtttcttctgcttatgcctctaatggttgggtagtactttctgagaaagaaggtatcagtactttagcttttttgagagaacagactgaagagggaatattaaagcctgttgttacacgtgatatttatcaaatgattaatggtgtaccgatgggaacacagcctgtttctatgtatcctcactggacagagcgctgggatggagaagataaaaccagttggctatgggtagcacagaagggtggtcaaggagctgttgatatatcaggtagcagttataagcaagaagggatattgtctcaaatgttccttagtaaatcatatccagaaggatttgttccggtaggtgttattgatatgcagtttctcacaatggcaattggtgaggatggaactatttatacccgcgttaaagatagcaatttattgtttaactctagtaatttccttgaccgaccattaacatctgatgaagaaggcaaggtaaaagtggatggtagcatgattgcttatgctccttttgatgaacatggaggtatggttctttatgataaaaattcttcgcaatatttgcatattgctgattataagagttggcaaggttataactattctggaaaggtactacctttgaaggtggaggagtatgagtatggtccttctgatgctaggttagataacatgaaggattattctgtatactttgtaggcgctagtttagttgattggggagatgtctcttatatgtctattattaaagataaagctggcaggttctatatacagaaatttacggtagaagcttatggaggaggtagttctgtcactaaagttggcgctagctttacatctcaaagtgagattgaggggctaagttcagtaattgacggaacgtccaaaaattgcttttatctttgccgcaatcaagataaagctccttatctttttataagtaaaggagagactctttatttttattatacggatggaaataagatatatacatgtgcccagtttgattctccaattacttcaatatctaatatatcatcattaaatggtaagtttgaagatataataggaagtccacatgcaatggcctctactatagcattagagcagccttcattcaaagtaggtaaacaaaacacatcagcagcactgagataagaagggatatcatcatgttctaatgctccaatatgaactattccattacaatgaggtgtcgcatcgtctcctggtactggctttcctataaaaataacttttatccttttatcaccaatcttatcaattgcagcagcaagtctagaagcccccttacgatggataaaaccaccggtaaaaacaattaaaaaatcatcatcaaaaactccaagtgaattcctattaagaggatttatatcagaaaaaagagaagaatttacagagttaggaagaacaacaatatcctcagcttttgacaacccatattctatacacttccttttattaagacttgatacacttatgacgcctgttaccgcattggaaagccttttcttttctgcaaaagataacgaattgacaagatcctccaatgctgtatctccttcaccacaagcaacaaacaatggtgtaccattcttatagcaatactttctaatatcaaaagcattttgccaaaaatggccataaatagcatcgggctttaaattatgttttgtgattactctcaagatgactttatatcttaaccattctaatatgttttgtatccatcttggagcatttccaagggttaaatatttcggacgataaatatgataacttcgattaccaattttcttttcagaatccactgctagcagagggtctccttttagtaaatggcgtgttatactttgaggagcgataacagatatatcaaccccttgattaaccatttcatttaccaactgctcaacaaaaacatattttggatgagatggagcaggataatcagttgatacaatacaaatattcattactatacaaataaattatacttcattccatgcaggaacatttcttttaacaatttctgctggtgtcccagcaataacaacatttgactcagtgaacgagcgatttacagttgcattagctcctatacttacattgtcagcaatagttatatcaccaaacaatattgcccctgggtacacattattcccaattatgggagcaccgtttttgcctctacttgcccctatgttgacgcatgaatgaattctacagttacgtccaatcttagctttacttgaaataataatagaaccataatgagcgatggacaatcctggaccacaaacattaataggtatagaaaaacctagatgcaattgaatttttcttaattttaatcgatgataaaaaagaaatgccctccccataattcctctattagaacaattggacagatattcaacaattcgtaattctcttaagaattccgaaatataatcaggtgctaagaaactaagaattctttctcgtaatgacacttttgcacttttattacaggccaatctatcactttcatgataataacgcagatcagtaatattttttatcataaaacactatttcttaatattattaataccattacgagttgaaataatagccccccataataaccataccaatagataaatgaattcaaatttacaatatcattatctgcaaacacatgaatagcaactactccgctccaataatagacaaagcctattacaaccaaacttataagcgttttaagaaaagtattcttagaccagaaaatgctccctagcaaaaataaagattgaacatatagattaagtgaaatcaataaaattccttgagaccaattatgacataatgaatacccaccatctccctggtcaacaaaatacttaaattgtgtcggttctatagaaggtatttccgaatataccattgagcaaatcaaaacgcgggtataatctgccaatatcataaaaaagtagataagtaacggaagaataagtacatagatcagccagtgaagaaaaaacttctcaaacgtactagcaggtaacatcaaatttgtaatacgccttggtttagacttcattgattcgaatgccaacgaagtaccaaggcacacaaatccccaccaagcccacatccaaatgaccagagtagttacatgcacattcaattcatcaaacgaatagagaggattatagcttttatattcagaacagcctacccatatcaatgcaattgccaaaactccatacatcatcaatgtgcgaagagtgtacaacttccaattctctaaaatctctttatggcataattttccaaagcgagaaaaactaaaaaatgtatcctttatcataatctattcttcttgagcgtgaaacaaattagcaatcttttgtggttgtgccagtattgcattaaatagcagttctatgttgatatctgaatcttcgttgtgttcattcagtaaaagcaaactattcccatgcaaagaaggaacggcaaaaagcgctttatcaatcagactacggtcatcactttccttaaagcacaatttctcgcatatatgcactgtcgattcattcaataatacccggctttcatccatgatcataacagaatccagcattttgtctatatcacgtatctgatgagttgaaatcacaattgttttattatctgtcatccccgatgccataaatttgcgaaactggctctttcccggaatatccaatccatttgtcggttcatccatcaataaaagagaagtattggtagctaaagcaaaactcataaatactttctttttttgccccatagaaagtgcccctaaattcacatccatatccatttcaaaacaatgaagatacttatacatatcctctttgctaaagtttggataaaaaggagcattcaagtcaatatactttttcaacgatatagaaggtaattcaaattcttccggaaccaagaacatatcctgcaatgtcattggcagacgagaacggacatttatatcatggtacattattttcccttttttcggagtcaataatccagttatcaaataaaggagggttgatttccctgccccattacgtcccaacagtccataaacccgacctgcctctaaagaaaaagaaaagtcgtgtaataccatgtgctttgatttgggataagtaaaagataaattctcaactttaatcataatattattttttagttgttagagctaatatatggtgctaagtgtgttagtttaatagtacactacaaaagtatactccgttacctaagaagtaacacaccagcatcagtgctgattatcaaatttttaaccattcaaattcgacctaaagggcaagtcttcacgtaatgcaaattcttacgatttacctctgtacgctctttcaactcaaaccccttcagataaatttgtgtcgtctttatagacttatgccctaaagattcactgatcatttcaattggaactccacggaacttggcagtagttgcccaagaatggcgaatcgtgtaagaagttaccggagaggtcaagtgcaaagccctcgccaaacttttcaaatgattattaaaccggcgaagtgcagactgatattcacgataagcacgttcatccttacgtttcttatcaccggaaaggatactgaaaaggtaatcggggcaacccggacgcgatgactgggaattgcgaagctgattcatcatttccttagctgtatccaaaacttccacactcattggagttctggttttaattcgattatatcggagcacattacaatctaaagccgacttttccaaatgagccaaatcggcaaaagacatcccacagaattgaaacatcaaagcagcaatcgattgtgtgcgccgcaaacaatccgtcttgggatcttcgtaaagaagccgtcggagttcactcaccggaagagcccttttctgacggatatccactcctgtatacacatcacggaacagaccatgtacatagggcgcactacccaactctaccccacggttatagatactgcgaagcatacgcatatacgttgataccgtattcggttttaagcccgaatcatacagatgttccccgtaacgacgcaatcggtcacgagtgacttgcctgaaagatacactggcattaccacaaaatttattaaaagagaaaagagcattttgatagacatgtgccgtagaaaaacgaccttcttttcgtaaaaggccgatgtatagttccccacatcggctaaatccatttttattcattatttgcatcactagttattttatatacaattatagggcgaaaatttggaatttccatcttaatgccatttattaattttatttaaatcaaaagaaatgacaacgacaaaaaaatgcctgaaaaatgcaactggcacacaaaagaagagaagtcttgaaactgattatcaggatgatgacgaaattattgacatcgatgaggtcagaaaaagaaatggcatcacaggcgaaaaaaaacactatttcattgcctgtcttcgcacttattacgaagatgacgagtttaattcctacgtaaaatctttaacaggactagccaagtacattgcagactggagaatcttttacgtaaacacacatcatggatatagattaatgaaattcaggagtatactcagcgaaattagcagtttaagcaaaggaatcggaataatttcgaagcacgaaaaagaagagaaagaacaatacaaatcaaagtatcacagtagaaaatagcaagaataattggagcgaaaaaatacaacttatacttttgcccccgttttttagataaagaaatgaacgaactatccggcagaaattatagtgtcactataacagcaagatagtgtcactatcccgacaggatagtgtaactatcatcgcacgatagtgtaagcgcacagagtactaatacaatattaaatactgttttcatgataaattatgtttttagttgttatattcgcatcgcaaaaatagaataaataaatttaaatacgatagttccgggaacttttttctcgtacaaaaatgataaataactatttagaaaggcaaattaaggaaaattttccttatcaaccaacttttgagcaggaaatagctgtaaaatctctttcagagtttctgctttccacactggcggatgaagtatttatcctcagaggctatgccggtactggtaaaacatctttggtaggggcattggtaaagacgatggatcagttacagcaaaaggctgtgttactggctcctaccggtcgtgctgcaaaagttttttcatcatatgccggtcacccggcttttacaattcataagaaaatataccggcagcagtcgttttctaatgaaaccagtaatttttcaataaatgacaatcttgctacgaatactttgtttatagtcgacgaagcttcaatgatttccaatgaaggattgtcgggcagtatgtttgggacgggaagattattggacgacctgatacagtttgtttattccggtcaggggtgccgtcttttgttgatgggagatactgcgcagcttcctccggtaggtgaggagttgagtccggcactttttgcagatgcattaaagggatatggattggaagtgcgggaagttgacttgacgcaagtggttcgtcagatacaggaatcgggcattttgtggaatgcgactcaattgcgtcagctgatagcggaagataattgctactctttacctaaaataaagataacaggttttccagatataaagatggtgccgggtacggaattgattgatgccatcactagttgttatgatcatgacggcatggatgagacgattgtgatctgtcgttctaataaacgcgcgaacctatataataacggaatacgtgcacagatcctttggcgggaagatgaactgaatacgggagatatgttgatgatagccaaaaataattattattggacagagcaatataaggaaatggacttcattgccaatggagaaatagcagtcgtgcgtcgtgtccgtaagacgcgtgagatgtatggttttcgctttgcggaagtgactctcaggtttcctgaccagaatgattttgaactggatgccaatttgctgctggatactcttcactctgattctcccgcattgccaaaagtagataatgacagattattttataccatacttgaagattacgcagatatatctaacaagcgggaccggatgaaaaagatgaaagcagatccacactacaatgcgttgcaggtgaaatatgcttatgcgataacttgtcataaagcacaaggtgggcaatggcagaatgtttttcttgatcagggatatatgacggatgaatatttgactccggattattttcgctggttgtatacggcatttactcgcgccacgaagacattgtatctggtgaattatcccaaagaacaaattttataaaagatttcttttttttcttcgtaaataattgattcccagtctagatgaatggggagatactcgttgtgaaaaaataaatatgagattatatttattttttttcaaaaacctctagttttatatctatacttatttcaaacaggacgcaaagtaagcacttttatccgtataaaacaaggatttcttaaaataattcacttccagacaccaatttttccttatttgagcaaatcacgaagaattaatagcgcattattgcccgctctttcaatattcatggctcttccgcggttcgtttcctgcctgtaagtacgaatttcatttttataaccagcagcgatccagacagtgcctaccggtttctccggtgttccacctccgggaccggcaattcctgaagttgcgacagcgcagtcggttttcagcgctttcatcgctccttttaccatttcgatcacagtctgctcactgacagcgccatacacttccagtgtttccggtgaaacatggagcagattcatcttcacttcgttagaatatgccactattcctccattaaagtattccgaacttccggcaatggacgtcagacgtgccgcaatacttcctccggtgcaactttctgcggtggaaacggttaaattcttctttttcagcagttcgcctacgattacctccagtgggatatcttcttcgctgaaaatatcatcgcccagtatcgcttccagcttagcctgctcgtcgttcagtgcgctttccacttctatcttgttctgtccccgtccggttagtcgcaggcggatgattccaagtttgggcagatatgccaatttgatgctttccggcaaggctgtctcccacggttccagcttttcagcgagtatggattcggggtaatgttgtactagaaaggtccggtgcatgattacatccgtctgaaacttctcacgtagcttgggcaatacggactcagtcataacggcagtcatttcctgcggaacacccggcatggatacgagtactttattgtctttctcaaaccagctgacagaagcgcttcctaccggattgttgatgaccgtgcaatctttgggaaccattgcctgactcttattcagcgcattcatcggtattttcccggcaagcacccgctttacgttctcaaatacttcttcgctgaatatcagttcggtatggaagtatttacagagagtttgtttggtgatatcgtcttttgtgggaccgagtcctccggttaccagaacgatattcacccttttcatcgcattatctactgcttccatgatctcttcttcccgatcacggatcgaaacaatgcgtagaacttcgatacctatcttatttaattcctgccccatccaggcagaatttgtatcgactacctgccctatcagcagctcgtcaccaatggtaataacttcagcaaacatctttttcctacgttagttaatagaatatgctacctatattaataaggtatatacgctatgttaagtcattaggtttacttcattttttcgttccatatacgtgatccattcggttcatgtgcgtgagccgaatggatcacgtatgtgaactggacggcttacgcacgtggaacgaaggaatgctataaacaaagattcttaatgaatgtacttccctaataatggttgacttgtttatctctaatagctgctatgtgttgactagaaatattactaaccctggcagctgtttactttattatttattattcctgcctccggtttacttattctatatatgttgtatttatatcttttatctggtaataataagattaatcggtaagatagttgctgtcacatcaccgctagatacgtcatatagtttataggtattgttagattctgctctgataatagggtcatagaagaagaaggaaagagttcctaattcgtcagaaccgactgtagttgtaactttagtactactagttgtggtattggtgtgtgaaaaaccatatcctaatttggcagataatttgacgctatctatgcttccgcctccttcgatggaaaaatctgctttgtttgtaaattcatttactacagttattgttttttctattgtctgatcaacatcgaattcttctacatacatatgaatggaaagagctttgttgtataaatcccatggtaatgtgaaaacttggttatccttattgggttcaagtttttccggataaatccattttgatcttaaattgttgatatctactgaatagaaattctttgattgtctaaatgcggtaccgtttttatgatgaagatgtatcttttctatggagaacacatcttttgcttttacggaaaatgtgagcaaatgttccatcgcatctttatttgtttctcctgcaatataggacttgaatcggaattcgaaatttccatctgtccatatattttgaagaatttcttcatttgaaaggtaacgtttagtttgggtcaagtcttgtaatctttgatcaccgtcggcatctgcgattcttccaaatgcagtagcactaattctaaatcggtataatttttctctgatatttctatttaagcttccaggagtatttgttttattgataccataataaatataatctctttggcaggcattagggacgtttttgaattctcgccaagcgttaatagctgtggctactacatctttactaacatatttattcaaatcttcggttgcttctaaatcattatcagcatcataatgccgggtttgcacctttttgctcccatcaaaagcatcacttataaattcataagtagcctctcctgatcttgtattaacactagtaattttcatgcgttcattgtttttcacaacaaggcaagggaaaccaggaatatctccgtttgtcatattaccaatgttttcgccattttcatatagtgtgttgtttttgtcatctctacacaatactgatatttctttatcacttgtatcccatgttgtggcattgaagtcccaaaatagagtgagatctggaaccattatgtttaacaagggaagagattgctcaatttgactcaattcgttttcttctttgcagtatgataataatatatctctaaaactttggttgccaaatacttttttatctttaattaatggatagaaaatgtcgtagtcattgtcaaactgtactaaagcttcttttttcaagaagttgcgtacttcgatactaccggaggcggcttgtgataacaatttggcaaatttgagttgcgcatcggctgttgccgatactggtaaattacttgtattctcgttgataggagaagttccttcctcttgagaacacgaaaacatgaaaaaagcacttgcgagcattaataaaatctttttcataatacatgtttttataaaagttagtaatagataaaaattatctggttccgtaaattaaagttatgtaaatacttaattattgaattttaatttttgcagaaattaatgcaggttcaaccttaattatagcacagaacttagtttattttgttcttagtattaactaaaagacaatagaatgaagaagattagttacagccttgtgtttaacagaaaaaagaagctgaacaaaaaaggaatggcattggtacaagtagaagcttacttaaacaggagaaaaatgtacttctcaaccagggtgtacctcaaaccagaccagtgggacgtaaaacgtagaatggtaaagaaccatcctaattcagatgcattaaatcgaatgctatatgattttatagctgacattgagcagaaagaactgggattatggcaacagagaagatcgatatccttggattcgttgaaagactctattgaaaaaccggaaaataatgggaattcatttctgaccttttttaaagaggaagtcagcaactcttctttaaaagagagcaccaggcagaatcatctttccactttagaattgctgcaagagtataaaaaggacattgtattcactgatttgacattcgaatttgtgtcttcatttgataattatctgcagtccaaggggtatcatctcaataccattgccaagcatatgaagcatttaaaacgatatgtgaatgtagctataaataaagagtatatggatattcagaagtatgctttcagaaaatataaaatcaaaagcatagaaggaagtcatacgcacttgtcgccggaagagctgaataaaatggaggaggtgaatctggaagggaagtttacgaagttacaaaagtcaaaagatgcctttttattttgttgttacgccggtttgcggtactctgattttataaatctgactgccgcgaatattgtcgaactccatcaggagacgtggctgatttacaaatctgttaaaacaggtattgatgtgcgccttcctttatatttattatttgaaggtaaaggactgcgggtgttggagacctacaaagacgatttaaacggattcttcaagctgaaagataactctaatgtgaataaagacttgaatgcattagccaagctggcagaaatagacaaacggatatcattccatacagcccgacatacaaacgccaccttattgatatatagtggtgcaaatataacgactgtacaaaagctgctgggacacaaaagtgtgaagacaactcaggtatatgcaaatatcatggacatgactattgtgcatgaccttgagaaagcagcctattcaaaattagctaatagaccaaaaagctaggcagtgattgtctggaaatgtcctgtttttaagattggtttcaacagagttgattcaaaatctaacaatatggcagaaataatgcataaatcaatgtaagaatatgcaatttacaaatgatttgtcgcatataaatgactgtaatatacataaaaagtgcaatgtcaggactctttccttttaaaggaacgatccgttcctttaaaaggaacagatcgttactcaccgaggaacatctaattgctttaaaaggaagagccaaaagtagttttaatttctaattctgttctaactgatagactttcctgtcacagggaaatatatcatatcgaaactaaatatttcttttatattcaaaggtgcaagctactttgcataattttatgtgataagaaatatttaatatttaactatgaagattatgaagaaaagattgttgtatttgttcatgcttatttgttccataagtttatttgtgagttgtagtgatgatgatgatgtgaaatatcctgttgatagtgaacttgcaggtgcatataagggaacgatggatgtatattatgtgggagtatctactcctattgcttctgatatggttcagaaggtttatatttcaaaggcttcagatactgccgttaaattagaattgagaaactttactattaccgtggcgggtactgaacttcttattggtgatataacagtggataattgtgctctgacaaaaagtggtgatacatataagttctcaggcaatcagaagttaagtcttgtggtgggtgtgtgcaatacatccgtttcggggacaattggtaaggatgctgtagatatggttattgatgtagatgtagaaggcggaatgaaagttaaagtcaattataaaggtgctaaactatcgggaagtgaaaaatcagaggctaaaattactagttttactattgataatgaggttgtgacagtagcgccggttattgatgaagaaaagggtacaatcttgtttaaagtgaatgacgaagctactgatgatgatttgaaatcattgactccgattattgaaatatcagaaaaagctacagtggctcccaaaagtggtgtcccacaggatttttccgctggtaaaactgttacctatacagttatagcagaagatggaacgactaaaaaatatgtagcttcaatagcgggtagtcagaattttttaaagtattcatttgatacttgggttgttcaacatgaaggtttgaaaaatgaatattggaatccggctccagtggatcaattgagcacttccaatgaaggagcagggcttttagctactttaggttttaaaggtggttttcctgtggtagaagataaagatggttatagtggctcctctgccaagttgataactttatatacaaaaggagctggttttggattggctcctgcgataacttcgggctctttatttactggtagttttaagaccgatgcatcagatcagttaaattctactaaatttggtattccatatgcaaaaaagcctttgatatttaaaggtatttataaatatactcctggtgataactatgtagatggttctgataaaaagaatgttctggagcatctggaaattgtggatgagtgctctataatggctgttttgtatgaagctgtggatagtgaaggcaaagaggtaatacttactgggcatgatattgcatcttcggagtatcgtgtagctgtagctgtattggaagatggtggagcaaaagctgagtggactacttttgagttgccattcaataatttggacggaaaatcttatgatatgtctaaatcatataaactggcaattgtatgttcctcaagtaaagatggtgcagcttttaaaggagctgtaaatagtactttaattatcgatgagttagaggttattggagaatgatgaggaggttagattgaatcaattagttagaaatataactttgaaaactatagtatttttgaataaaaaggggggattttaatctccccttatttaatgctcttttgttagatgtagtgtaaatatgaaccttaaaaactctataataacaattatacatctgaataaaatcagactctttatttttttcagtatctagagaataaatcaaattatgacgtatcatcagaccatcaacagccttcgctcgaatggcacatgagctattttttctcatataaaaataattttcttcaatagtaatatttttatgaaccgcccctttatattctctattctccggatcaatgctaataatcggttctccacagtttaaaaacgtattttgacgaatagtcaagtcatgtaccggtcctgactcataccagcttaatccatcatcggctacaaatattccactcatctgcatgccgtagaatgtatttccttctatcagagacttacgtcgtgttgtgataagaatccctctggttggtactcttgcaaagtaattgtttgtaatccgcacttccggtgtccacgtcacgttctcaataaccaggtctttctgttgcattacctccgaagagagtggacttgacagagtgagttccatttctcttggcgttactaattttgcctcttttactttacacttccctactaccaacagagaacgtgaatcaacaagttctatatcgtctcctttaaaaaaggcttcaaatccaaaagtctggtcatgcataaaacgaagttttaaacgattgtccgacaaaaattctattactcgcaaatgtgtaccatgtatatttataggatcatcgtgtgcacctataaaacgggaattcttaatatcaatcataccacggcaaccagaaacctgaataaaatcagcaaatcccgcattagtacgtcctgaacctggacgaggagcaaagttacaacgatcaacagtaatattctcactgtattgacagactaccccgaaatttcctaaataatagaagttgatattctccaacagtattcccttacttctgtttacaaatccactcacttcgtcacggaaagaatcgcgcatctgaaaaatagtatgtagtcctacttgtggtttttctttatattgcagatataacacatttggacgaagttctactgtacgaagcaaattctccatcggactccaagaacgccaagtcatttcacttatacggtcatacgactgcgctattccgttcttaaaagaccaaccatcaccataccactccaactgtgcgtctacaatccgatattgggatgtgggatgtacctgaacaatcaaataatcattcccctcttccaatacttcaacctctgtttgagtaggatgtttataatctatattaaaatttttcaaaacaataccttcacatttatcaagtacgaaacttgtcatttcaccattcatcaataaagttgacccacaaccatcaatagtgatattctttaatgtattaagatacaatccgatatgtttagtcggatcaggatcatccaactcagaagtcgtatttgatatataatataacacttgtgatgatttcgcacggtctaactgataaattcccggtgaaaactttacagtaaccggccttcctttacagtcagcagctttttttaaagctaacgctatattttcaatatcttttccctgctccggaaaaacctctattattctagactgggcaaaaatagccaactggatgaaccaaacgctcatcataaataaaatgtactttttcatgatattgatcttcaaattttacttttttcacaaagatagaaattatctataccctattatagatataaagcaaagtgggtgaaaccgccgaaatcaggtgtcagcttcaccgggacgggcggtttgaggaaacaaagtatttcatccgctatttccagccggacggggcgggaacgctgaaaatgtccgatgggacgggtttactgccgaatgacctgtacccgcttccgggtgaaacattccggctttactatacctctgcatccaccgaccagcaaacggtagatgtgtattttcaggacagcttcgggcagttgcagcagcttacattttcgttcaataatgatagcagtaaagaggaggaataacctttttgtgtaaatgtgttaagaaacattcagcaatatattgttgagtgtttctttttatctacttttgtataaaagtttaagtattaaaaatgaattatatatggcttcttttgatttcaacccaatagcggattatgtggtactaaaattcaagtgtcctgaatgtggtactgaaaatgaaacagatgcactttctgttcctacgcctgattttgcagcagaaaatcatcgagatagttgcaattatgatgagtatgaacatgaatgttcaaattgtggacatatatttgacataacaataaataatggaatatatggaggcgatggggaaatatcagacgtagatgatgtttcggtagaagaggagtttccagaggatgattactatgaagaatttaaatcatcgttctttgatgaacatgttgtagaaacaattgatgttttagataaaatagatgccttagacgagatttcacgtaaattattgtaccgtactttatatgctaatgttatcagtagtatggaagcatatttgagtgatagacttattcaaaaagtattgtcttcagaagataataaacggctatttgtagaaaactttaaggacttcaacgactctaaaatatctatctcagatatttttaagcaaatggaaaatttggattcctatataaaaaagacattacgtgatattatatatcataatcttcctcgtgttaagaacatctataaaacaactttaagcgttgatttaggtgatgtgtctgaattaatgaaatgcattagtattcgccatgatatagttcatcgaaatggcaaggataaaaatggaaatcttcgtgatattagcaaggatgatgtttcaatattggctcagaaagtttctgattttattcaaaatatagagaaccaatttcttatgcagtcaatagatgattcagaaatagattcactttttaacttataaacaataaaacaaggctgacattatcaatcttgttttatatgatgtctccagtgtgaaactcaaaaatacagttatgccaaacattgataatgtatttagtatatatgcaggtcaattggagttattacgccaaaatggactaattgaaagaacgggtgaatacatttgtcctatttgcttaaatagttttaataaagaacaattaaataaactatcgatggaagatgcacctcaagcatctttaggtggaaagaaaattgctataacgtgtaaaaaatgcaataacacttgtggacatgaaacagatattcatcttgtgaattttattacctatttagaagaacaagagtttcttccgggttctaatagacgagttaaaatcttcgatgatgaaactactataaatgcaaatttagaagttggaaatactaaagaattaaagatgattattcctaataagataaacaaccctaaagctttaacaaatcatctttctaaattaacagtaggaggtattaattatagaccgaatcatcaatctatagaataatgggaaacgatgaaattattcattatattataaaatagtaatgaaggcgtatattataaatctaaaaaaatctgttgaccgtaaaaagtatatgcaggagcagcttgaaaaaatgttctttttatctgctgagtttgtagaagctgtggatgctagagggatgactgaaagagagaaaaatgttttttttgatactgagcttttttgtaaaagatatgtaaaagaggttcgtccgggagaaattggctgtacgcttagtcatcagaaatgttatagaaaattagtggagtcaagagataaatatgcactgattttggaagatgatatcgtgattcgtcataatattgatactcttgttcctgagattgagaaactattgaataccgatgagccccgtgtcatacttctgtctggttggtattggtacttgggtacaaagacaattaaacaacattattgtctagctcgtgtatatgatgcctttttgacccatgcttacattataaatcgagaagcagcttctttgttgatagaacagcgaccttttattactgctgatgattggttttatattcgcaagaagggggtcaaactgtatgccgtgcttcctcacttgttagatcaggactggagtggggagtaccctacatccatcaaccaagaagaaaaaaaacgatgtccagggttgtggaaaagaaagatagaaatttgttttcactcattactcttgaagtttttatatatcataaagcggtttgaaaaagcgtaactcacaatgctggaagtagatgttgttagaataagtgtaattgttccgatttataatgtaaagttatatattgagcgttgtgtacgttctttgatggagcagacattggaaaatatagagtttatttttgtgaatgattgtactccagatgatagtatggatattttacattatgtattggaggagtatccaaaacgtcgcgaacagattaaaataatagaacatgagacgaataggggtatatcagcagtgagaaatactggtttaaagaatgcgacaggacaatatattatatattgtgatagtgatgattgggtagagaagaatatgtatgaaaaattattggtaaaggcgcttgaaacaagtgcggatattgtagggtgtgacttctttgatgactatgttgctcactctacaatacgaaaacaattatttccgcaacaatcagaaaagtgtgtgaagaaaatgctaagaggagaattacattgtggtacttggaataaattagtaattaaaagtctttatgaacggacgaagatagactttcccgaaggtatcaatatgtgggaggatgtatctactatcattcctttatgctttcatgctactaaaatagattatattcctgaagcactttatcattatattcatcataatgtgagttcatatacatatagtgttactgagaaatctttagaaaatttagttgcttctattcaattacttgaatctttttttcttactaatcaatgtttcaaaacatttggggaagacttgtgctttatgaagcttactgttaaattaaacctattgttgggcagcaaaggtgaattgcaaaaaaaaaggaatatgttatattcttcagctaatcgttatatcttttcttattccggtatgtcatggtattggaaaatagctctttgggtggcttcaaaaaaaatgttgttttgttttaatgtcatgtcgtgtatagagagaataattaaaaaatggaaataaataataatcgatttgatatatttttcttcttctcctgttatcatatcaagcccgatacctttaattactgtttttcttcgttgataaatacctaaatacttagattcaacttcataagtaatctggggataaaaaacaaagtcccacagtctctccctatatatcggctttatcgtatcgggcatactcagagcctccttccattctttcaactgagccggagaactttctgacgagctaccggctgtactcaataccagacaccccaataaataagttttctctatcgtttctttataattgctcaatctgccttccggcatcgtatccagcatattattactaatatctaccttccgaaatccgtctaaatcaggtttggaagtacaagcaaacaaacaagctgacagacttaaaactgcaatagactttatgactttcatttccttttcatttatgttcaacgattcaatataatctcactcttctgattcaaggtcagctcaagttctgcatctctgacctgaggactccagaagatacgattacaatttatacctggccgatacttatgcgaatcttttcctgataaatacagattctcaaccataaactgagtagtctcacgacttctaaaagtccctaactcttcataatagtttgtagcctctacccactcagctttcaattgcaacttctctccttttatatccaacgaacgaaagcgacaagaagtcaatgagatattctgccattcgtcattaaagagatataaagagtccaaacacaatttccttacattaatatccagcctagccgcacgattctcaatagataacaatgttgaatccgttttcaattccagattcaaaccatctaaaaccaatctgcatccattttctacctgtctaattacctgatagatatcttcattatccagattaatttcaatcaataagcaatccccttcttgtgtcacatgcaaatattgacttttcggatacacaaatatactcttacctgaagagtgagaagcctccacatccaactgacctaacacgcctatatgatctttatctatcttccctagcttttcaacaaccttcacatgacggattcccgtcatttctatttcagtccgctcaccttccattgataaacgattatcggttttctcaccgccaggtgtatgcagaaggataggtataaagaataagcccaatacaaaaagtcctattattatatatgttgtgcgtttcatatcttatctgtttattattgattttgtctttgtataaactcataatacatcttctctatttctttgatagaaataccaagtgtataaagttgcctgaaaaagctaccgacttcttcttttaagaattgctcttttcgcaatgaatgaatcagcatctttgccccggacgctacaaaaaagccaatccctcttttattgtaaatcacctcctgagactgaagatactcatacgaacgcattactgtatttgcattcacttctacaatagacgcatattccctgacagaagggatacgtccttcttcctcgtattgtcccaacaagatgtcatcacaaatacggtcggctatctgtaaatatattgctctgctttctttaaaattcatacataccctccttttctatattcgatggattacttccgactctttcaagcggaaataagtcaatgtccaatttataatagtcaatattgggaataagatgtgtccccatttaaagataaatgaattcaaatttacaatatcattatctgcaaacacatgaatagcaactactcatataagggcttattctcagctatacaagcgatttcggaaatgtgcgttaataagttagttaatataagaaataagcatataacatattgatatacatatatttatcaaattcatattatttattcagcacactcagcaaataatgtcccggcagtttaatcttcccaccgcttccacgaatgacgctaaagcctttccatatatcaccaccgatttcaccgtaattacttttcagcactatagcatattgttccgcaggaggaacacgaaagagacggagattctccagcagaccggaaaaattgcggggacatccgtccgggggaacctgcatccggtcgatatcttcctgcgtcagattccgtttcctcgtggcagatcgctgatcgcattcttctctcatcccgcctccggctccttcagctactttctctccttcactcccttcttcttcatcccctccttttgcgaaaggagggttagggaagatgttttctttcttttctttttcttttctttttatgagagctgtttttgttgcagtatcccgggatgccgttgcaatattcggggatactgcaacattttcccctgttgcggcaacagtatctggctgctcatccgttgttttctcttccggcagcagacaataatccggacagatatggtgacgactgcgacgtttggtgatgaagagatactgccgctggacatcctcagaagtcagaatgctgtaacgctcataaagcgcagagtcaaaaagcccgtattcaagaaacagacggatgacacggcggacggtatcgttgtccgtactgaaaagctgatcggaaagttcgtcacagaaatcggtgtcggcacggacatagtagccctcgcccgaatagagataagacataatatagattaaaacggtgaaagcggaatcgccctcacgcttcatgacacgacgaacgatacggtcgtgcatgaagtcggtgctcaggggaaagtagtccagtccctgtttgattcttcccatagttgtattgtttttataaatagtttatcagtcagttttttcattttgttaatcattcagttccgcttccacttcacaaagtttctgctttttccgcttgatacttgcccttacaatctgcagggcggacagaatcagtttctgacgaagatcggggtctttcgtagaggtgataacgggataaggttcacggtcgtcacgtgccagcgtgcgcttctcggtcttcctgtatttccggctggcggatttgcggcattccttgcagtagttgtttggaaggccggttttcttatctacgtaaaaggcttctgaaggaagcgtgtgtttgcaacagccgcaaacgtaaagtgtttgtttttgtaatgtttccattccggttattctttttgatatacttgatatgttttcagataaaaggtaaggcagcctgcgcacaggaggttcacatcctacacaatgatcattggcaacttgcccgtcagatgttaacagccatcacgtcagctgttaatacccaatataacaactgttaactcctgacaaatcaactattaacagctgacagctctcttttcggagggggagaatgcggtttttgaaagtatttcgcatctttttcttgttttctcatggtttatctaatttttatttctaattttgaaatcaaatattcatttcgaataccacaaaggtatagtaagtcgcatatataaaacaaataattttagatattaacgctgaattattttacaaaagactgtatatgaggcgataaggcaagaataaatattaacatataaaaaagtaagcaaaaacatgaatgacatatgccatcggattaatctgatgcaaagctacaaattcaagtccgttcgctcggaaaatcgctgtaactaactaaatttcaaatatttcaaagaactcttttagattttaatgggacagcaatggtattattatttgagttttatgtaatacgatctgctttttgtattcgttaacataacggtgtaatacttttcttaaacttactgttcatatttgcagcgttaaacatcaaatatgaacagtatatgaaaaaactactatttttattattcctgagtattttcttttcggatctaatactaggaaattctccaaattgtaatataaaaagttacagtatggaattgagttatttttctagaaaaataattttaaaagggaagggagctttggataacaaaacgactcgaataccagctatctacccagtggaggcatctataaataatgatgtattgtatatcgactttctttcaaaagtatctagtgtgacagttaccgtagttaatttggatactaataagacagtgtatctaaatacttttattagtcctataagtttaattactttagatttaagtttgaaggaaggggtcgcttaccgcttagaacttttgtctaaagattatgatttatcgggggattttgaactttaattaactatagtattatgagaaaaatatttatacaatttagtttgttagtcgtgcttattattattgcctcgtgtagtaacgagaatataatagatgcagaacggaatgcaattaaacaagtagatcctaatgcgttatctgaaaaagaagttatttctattgtagaatcctttcaaaagtctatcaaatctgagacaaatacgagaggcgaaataacagaaaatccaatttttgctattagtgagaaatatttaatatcgtctcgaaattcagaaattacccgttcgttgcctaatgatgtaaaagctttagtttatgaagttgaaataaggaatagctctgaacaagggaaagctattgtatctggtgatagaaaattcccaaaggtattggcgtatataccttcctataatgactccatttttgcaacgcagataggagcaaacgctatgattcaaatgtcgaagaatgcattattagacgaaatagccaataatagtgaggcaattacacgctctaggcctattactgatttagatggccaggtttggatgatgattgaacctttctgtactacagaatggggacagaaagaaccatatagttggaagtttgtaaatacttgggttgaaatacctatggatatttctcgtaaaatatgtacatgggaaagacgcccagtaggacttactaacactgcaatagcccaaattatggcctccttagagcctgaattaacttgtgaagggatatcaatggactggagttatttaaaagaaagtaaaagtattagttatgatgatccttatgagaaatggaatatggttgcatctttatttaaatatgtatatgatagtacatcttcttctccagtttggggaactgcctatactgatgtatggccggactcagaatctaaattagtgtcttgcattactgcaatatcaactccattatctaatgtgtataaatatctaaattcaggaagtggaataaccaattgtggtaatattcaaaaatggagtatagaaacagttaaaaattctgttattaaaatatgtcctgttttggtagaatgtaatggaagtgcttttatagtggatggttatgcaatgacaaagaacgaatcttctagcagtaatgcatattttcattgtaattttggaaagacaggtaattctgatggttattatttggtaaacaataaatatattggaagctaaaattaggatccatacacttagttatgaattctacattattcctatatgcttttatgttttcaatagtggattctttcctacttctcgcattttgctaagttcttcttctttaaaatcacttcttctcacattcgaaatcttataagagtaaatcagacgattctcattatcagctaaaataatgtcttgcgcatagaggttatcatcaactttatcacctttgacaagatccttaatcgaactaaggtattgactagcctcttctctaatgtttgtatattctttttctatatggtcacatgtttttatttctaatgtattccacattgaaagaaactcagaactatttccttttaaccatagttcaataaataaaaacgtaacattattttcacaaaaagcatacgcattaccctcgtaacatctgccatatagatcgttttcgaatgagaccttcatgacttctctgcctataaaagaagattcttcaattccatttttgaacaaagctttattaaaaaggggaatttttgctttaataacttgttgatccaatagtaaagtaggatttatttgttgattcatgcacataaccattgccatcacatctattatgtcctccctattggaatgtgataatgatataagctgtccttgaggaactgactggaagttgttctatctcaaatttccaagaatcaggaattctaatactaaaataatcacattcataattatgcaagttttggcatgagattaaaaataatacccccgccaatagcatgaattcaagtttcattttcatatacatattttacttccaaattataatataaagtttctcaataaaataagacattttcagtcttaactatttggtctttacagaaatactatataaagaattatctctaaaaattgaaaccgatttatttcccttcggattccccttatcaaaatcaaatgtaaactccaaaagattgttattagaaattgcctttatctttgctttcagcactttacgtccttcaaaccctataattttaggtttttctaaaacatttggctttaaatcagctctttttaatcgcaataaccacgaattataaggtaactcccattcaaatttaaaagcttttatccattgttgtggcataatagtagacctcgtaatatacatataatcaataatagcatctccatcagtatccttaaagattactccttcaatattatatgtaatcccttgttcatctattggattttgtccttaattccgcaactcaatcgtcgttgtttttcccaaatacacacccaaaacgggaaaaaacacactatcaaaattctttcgtatcgtacttacaaccggctgagatactgacatgaccacaggctttttatcatcataaagcttctcaaaaacatcattggctgattctaaagcttttagatttgaataaaatacttgcatatattccttcatgctagacacatattgttctatttgaagaacagcagtattttcttcacaatacatttttacacatttatgagttgcattaatttcattacaaatttccaacattaattcctttttataagcatctggtcccactaaagaaaatccacgtcgactaaatgttataaaaaacggttcctcatctgaaatagtaatccagtgcagcactccttcttttttaaaataaatgacatttgatccatccttttgattggaaaagaatccttcttctttcaagaaattaatcaattcattctgaaaaacattctgtttaggagtcaattctcctcctaaagtcagatcaaccgaacataataaaaagattataattattacctttaacctttggtaattgtttttccaacaaatattgacaggccatttgtttcttaaagaatacaggatagatcaaagttatatctatcatattctgcaactccattaacatattaaacgacccctgctttcctccgtctgtagcaggataaggcatccatggcaatgtaataagatatttcataaaacattatttagacttaaaaacttccaaaatagaactcatcatttgctcatagttattataataattcaaagctgttttttgacatgctattacatcaaaatgtaatattcgattaatcacaatatcaacaggtggacatttccaaaagcgagaatacgcattgatacgattatcaagtaaagaaaaacgtgacataatatcataaattttactcgattcttcgacacatacacaacgtgcatatttaagtacaccataggtatcaaaacaaaaacatggtactgcattatgtagagccacaacaataggatgcatattttccccaatatatcctttagcatattttatcaaggcataccaatctaatggaggtagcggagtagtaatagaaaaatcaaaattatgcttaaactcaataccagtcggcataggaagagcaacacattctaaatatagctttttcatttctgattttaatttatccatccatagcatattatcaagcattctacatttcatgcttacaagaacataattttcaggcaaatgatattttaaaagaatatcttcttttgaaggaatgaatttagcacaattataattaaaggcaaatactggatcgggagttatatttggtattattgccccttttgttatataagtaatcatatcacgagtccatatatctcgaaccgaaatatattcgaagtgagacaaattattactcattttatgctttaccgaacgcgctatcaatctatatttcgcattctgtgatgatgcagacataatcaccattggaattttagacccaagtttatcataaaatgtaccccaaaaagcattaggatactcacgttcagatgtagttttattaacacgtacaactgttttggttggaaaatccaatctaccccaaaaagacgaacactgaagaactgcatcactgccaataattataccttctattttttcatcctttatcacttgacaaatatcatcatcattacgacatattttggtctgcggaagatatttctctacaaaatgaaaatgctcttgtggttgcttctgagttttaatacttgtgaaacgagcttcaaaatcttctggctcccacttaatcaaaataggattatatccgtgattctgtagatagcttatcgtagatagtgcttgtaaattagccccaaaattagggacattagcaaatgttagaattccgatcttcattatttattaatatattttcttgtccgatacttactaaataaaaagcagaaaaaaagagtaaacaaaatttcaagattcccccaatccccttgaagaacaaagaaaaaaacaccattgatcagtgtgtaggctaacattcccaaagctatgaacttaggcagtgtcagtacattgtaaggtcgcattttctttaccataaaaaacgataaaagcaaaccaataacaatagtgccaacaaaaccaaactcaatattcagaccgcctacaaatgtatagaatacatgggtgtcaacacctgtaatattatcaagccactcccatttttcacgtgttgttttaaaatttgaggaaattcccataagcttacgaaaaaaaacaaaatatgcctctccccatgtattaccttttaactcatagaaaaaatgtgtattataattattaaaagactctcctaaatacctattattattacccggtcttcaccaggtattcgcaacaagcactataaagaaagtagccccgaccttttggtgggcaggaatgaagaatcccgaattgcagatactattatatggtgaccgcatatcatccgcagacgtcagtctttctgccgataatatcacgctgcaagaagtggtgaagcaggagaatcctaattatctggttctgtatttagacctttcgaaggctgctccacagaactttgacatcatcctgaaacaaggcaaaaagcagacaaaaatcccttacgagcttaaacagcgccggccgaatgcttcggcagtagaaggttttgattcgagcgacgtgctttatcttattatgccggaccgttttgccaatggcaacccctccaacgacatcattcccggaatgctggaaggaaatgtagaccgtaatgagcctttcgcacgtcatggcggtgatttgaaaggaatagagaatcatctggattacatagcagacctcggagtcaccagtatatggctcaacccgattcaggaaaatgacatgaaagaaggatcgtatcacggttatgccattaccgattattatcaggtagaccgccgcttcggcagtaacgaagagttccgcaaacttactcaggaagctaatgccaaagggctgaaagtcgtaatggacatgatcttcaaccattgcggttcggacaactatctgtttaaagatatgccctccaaagactggtttaactttgaaggcaactacgtgcagaccagcttcaagactgccactcaaatggacccgtatgcttccgattacgaaaagaaaatcgctatcgacggttggttcacactgaccatgccggacttcaaccaaagaaaccgtcatgtagctacttatctgatacagagcagtatctggtggattgaatacgccggtatcaacggcatccgtcaggatacacacccttatgccgacttcgatatgatggcacgctggtgcaaagcggtcaatgaagaatatcccaagttcaacattgtaggtgaaacatggctgggcaacaatgtactcatctcctactggcagaaagacagcagactcgcttatccgaagaacagcaatctcccgactgtcatggacttcccgctaatggaagagatgaacaaggctttcgacgaagagactaccgaatggaacggaggacttttcagactctacgaatatctatcacaggacatcgtctacagccatccaatgagcctgctgaccttcctcgacaatcacgatacttcccgcttctaccgttcggaagcagatacaaagaatctggaccgatacaagcaagccctgacgttcttactgacaacccgcggaataccgcagatatattatggaactgaaatcctgatggcagccgacaaggcgaatggagacggcctgctccgctgcgacttccccggaggctggccgaacgatacaaaaaactgctttgacgcagccaaccgcactccacagcaaaatgaagcattctcctttatgcaaaaactgctccaatggagaaaaggaaacgaagtcattgccaaaggtcagctcaaacatttcgcaccgaataaaggtgtctacgtttacgaacgcaaatacggtgataaatcagtcgttgttttcctgaatggaaacgaccgggaacagaccattgacctggttccttaccaagaaatacttcctgcctcatctgctttcgatttattgacagagaaaaaggttgaattaagaaatgaattaacacttccaagtcgtgaaatataccttttatccttttaataagttcacttcaacttatatttatcagaatacagaaaagaaataaactactgtaaaacaaaacattaacattaatacaaacatgttaatatacggaattatttctacattatatggataattacccttgccggctgctctagtagaaggaaaagtaggtccttcacctccattaaaaatacccgccaaataataaccattactattaccattccagccccagtttagatgcaggtaatcttctttctccgtatacgaatgatgaactttatcgcttccttttctatagacatcaacatttctctctctatgaaaatagccatcagaaacccaagcatgaccattttggtaatatttaatacccagtattttctttcttaccgaattgccacatattataaccggacatttagctttaatagatgttataacatcccattgactataaatttgaggattattgggtttcctatatcccattttctcgaagcattgtggtatattttttcttttagctccgcttgtatctgttccccaatccattttaaccaaatcacctatagagcggaataaatgggcaactgctggagtggtggggaattgtttcatttcagaccaattatatgacaccccattataccctgaaggtttttcatgatatgccattacttgagctattgcagtagctacacagcctgtgagggctctttgtccttctataagaggtgccgcattgttatatggactcctttgtccccatttaacagaaatcaaaggttgtactctttccgtttcttcccattctccaggtttctttatataaataggacgtcttctaccccttgtttgagatgtgtctaaagagttatcgtcatcattttcttctttgaactctatctcatactttttattattagaaatgtaattttgaactaaatcaaaaaagaaagataattcctgatattgaagcgtgtcacttaaagaaagattgccagactctgaataagcaataataggagttgtatataggttggccgatactattgcatagccattgccaccctctgcattggctatataaaatgagggatatgtctgattagtaattgtatctctatagaaatagatttcattgtttattgaataattaagaaaagagctatttcgtgtattgtttctattatttttaataaaaagttccacttcaataatagcattctctttagtacgataagtcggggctttttctgttaaagatggtggcgaagattcttgtttcattacttctgtgtcatcggaacatgaagttaaaaacataattgtcaaaatcaataaatgtgcatgttgtttcataatttatataattaaggttaatactgaatacgttaaaagtcaaaagtgccatgtttataagaggaccgggaaggtttataataatcctcacccggggtctggggttgtataaaatcttgtctgaatatttctgtaggattatctgtaattaaatctgcatcatgggtatatatgttaaaatagcactctggatctgttttttggttatatggtccttctcccacaaaagaaaatttgtaaaaaccaattttttctccgtcttttctgactgtaaggaaccagacattaccactacttatcgttttaaatctcaatccgtttaatgatgaataagtttcctctataaactggccattcaaatatgtctgttttttacaagtaaaaggtaactcaaatctaccaccttcagctggtagaataaaaggattctgttccgaatggattttatacacaaatgtcaactttcctttatctataattagtggaattttttctacttttatgccattaatagtagagtaagaaatctgtaaatcagcattcaaaattttatcttctttattaatatttgaggttatatttaatactacctgatcgccctccacttttatttctatatcagaaaaaagagttttatcaaattctaccgaaacatccctggggcatttaactttatcgaatcaaaccatttaaatgatataaacagcaaagatattcacataaataacaatatcctctttgaacaaatattgttttatgcccagtcaaacagttataacaaacctgtggcaacagtccttgatcacagcgttcgtgacaatggatacatttatgatgatttctgtaatttttatctatacgacaaagccaaactattacatatcatcggcggacataaaaagaaccaacggatttgtgatttacttagcaaaactctattaaataaatatcctgactattacaatagagtagtagaattgttcgcgaataatcataagcgaatgcaaaacaaggctaaaaatactaccttccccgatttgagtgtacaaatgtgtattgcatcctatcaagattatcttcattctttgtccaaaaaatgggaaaagctatcttataccgatctgtatgattgggagaaatgctcatcttcctatttcatgtttctaaatgccggaaaagaggaacaagccatatttactattaatagaaatccctacctatccatttacgaaattccggaaccctggccgacagaagcaaaaaaactgcttaaagaacgtataaacaaagagtgccattcagaccactttgatatagtatgcattccatgtctgctatatgagggttttaaagaagtgcttattaacgatttatgttataatattctgattctcatagaagaagagaagacatttgaatgtctgttcaacgaattgctaccttgtttttcatctgaaatcagcaaagataaagaacaaacttacaaattaattctgacggaagtagaatatcttctttatcatggggtgatatgtatcaattgatttcaacttaaacaagtgtataaacttatctatgcatccaaaagaaacgactttatttataaacactaaaattatcatgtattatggaaaagaaaagtaaagcggagaaattaaaattaagagggatcaaccaaaccatattgatctccagttacaattcaggggcaggtacaggtcccaatgattgcatgacagaagaagtttatcaacggcttaatgcccaaggagccttagataccaccgtctatgtatgtggcattggatggatgacaccggacgtaactatctacggtagcggatcaggtttcggttccggtagtggttccggcagcggtagtggttctggcgagtattggggaagcggacactggggaagtggagattggggaagtggtagcgggtggactggtggtggaactagtggtggaggaactagcggtggaggaactagcggtgatggtccgaaacctggaggtggagacaaacccgttcccaaagatccaatagaattaatggacaaaagtaggtttgttggttggagagaaggagctaattgcttaagtctttgcaaagaaacactaaaaaaatatggattatccaattacggaagtagcttaaatgtttttaagctagttgattctgcaaatggattattaacaaactggggaaatgatccagctcaaaactacaaaaatgcaattgaatgtatcgataaacatctcaatgcaaaacgagttatcatagtaggagttgattatgatctcgatttaaatccaaacatcgacggtacagaccattttattgtagttacaggaagaggatatgatacttcacgacaacagtattactatacatttatggataatgcaacttccaactctgatgatggatgtagcaacattaatcgcctttactacaaaactgaaaatttaaagctagagggaagcacaaaggttgctaacagatattatactgtaactcaagtaagacccaacgacggtgggaaatatgatacaacatctttataatataaaaatgtataacctagaacgaaacattattgtacagattacatattcaattgaaacttaaaaatatttattatgaaattaaagtattattttttgtttttcgtattgtcgttattagcttcatgtaatgatgaagaaggtttggatttacataataagccgatagaatctaactcaattgtattatctccggatgaatacattagtattgcttatgataatccaagagtaataactcctgatgaggcaaagcaacttgtattagattttggggttaacagagtgcagacgagaggtaatgaaaatattgttgtgaagtttcgctcttcttttaatattgaagaaaagggcagcaatgcggtaacaagatcggttacagacaaatcaattcttcttcctgtctatgaaatggaaatagtcagtgatgcagggaaaggacttgcttatgtttctgctgatgagcgtgtggcaaaggttatggcttatttgcccaaggtaaatcttgaggatacagctaaaattattggtgcgaaggctatgcttggtttgtcagaacaaagcttgttagaggaggccaaacattatgaaaaaatgaaattggaatttagagatgaaacattaaaaagaatatcgaaagagctcaatgttgcagccgtaaattttaatgagatcaaagataggattcttgtcgaggattgtctagattcacgtgcaacccctcaagatcctgctggcaatgctattgggtgggctggttttttttgtatggcgacaaattgggatcaagaacctgtatataatgatttattagagaaagcatattgtgcaccaaatgttgggaaggaacctgtatataaagctgttcctgcgggttgttcggttgttgccatggcacaaattatggcttcacttgaaccaaacttaactatcgatggtataaaaatagattgggaagcattgaaagcacagccgcagatactaatgccgctaccctggaagccaaatcagggatcacctgagattgttagaactatggttgctaaattatttaaacatatttatgacctttctggtactcatccagaatatgacaaaacaacaaattgggtaacaggttctggtacatctggacctcaaactagggattttcttagaagatattttacaacaggagatttgataaatggttgggatggtaatgctgcatttttgtctttacagaaagctaaactggtatgggttggcgtttcagatgcttctaaaaaagcttctcatgcttttgtgatagatggatttgcttattggagacctcaaacgagatatttggttaaaaactttgatttttatttccgtgcgaatatgggatgggctgggtcttatgatggcttctatttagttaataaagatatgtcgatatcttttgaagctggaggctatgaattaaacacaggctttaatatgatctgtgatattatattgtaaaagaatgaagtatattattctgatttttcttcttgctattgttagttgtaatgatgcagaagatgatgaaatatatatcaatgattttccccacaggatatcagagcctccattattagataataaaggtgatactgcttttattattatgactcctgcggaaggatggagattgcatgctgctgggactgttgtgaataaggattctattgctctcaatgtaaaaatgacccatacttttttgcttgaagaagattggttttcaataaaaaaagaacaggaggattcggtgatgacagtaattgtagacgaaaatacatctggtgatattagggagataatcttatggctttcttatattggctcatcaatgagcacatatacaataaagcaaaatccataaattatataacttatgaaattgaaatactattttttgttagttatccttgctttatttacttcatgtagtaatgaactaggtatgcaagataatctgaatgaatagaatatttaaaacaatataggatgatgatgaaatatataagattaataattccttgtattgtgcttgcttcggtattcgttgcatgttcatcagctgataaacggttggaatatgctctctcttttgccggagataatcggggagagctggaaaaggttttggaacattatggacaggaacctgaaaagttggaagcagcacgtttcctcatccgaaatatgcctcattggtatgcttacgaagggtggcagctggattctgttcgtcaaatgcttgcattgagaaagttggataaggaatcgattaagaaatggaagcaagtttcattttactctttacctaaagtttatgatgcacaggtaattactagtaattatttaatagagaatatagacctggcattcaaggtatggaagaaatatccttggaacagaagtcttgactttgatgatttttgcgaattcatcttgccttaccgcattgataatgaacctttatcatcgtggagaaaactttattatgaacattatactcccattctagactctctttatcatggagaagatgtggtgtatgcttgtcggatggtatgcggagaattgaagaaacgagagttgtattattttacagaacttattataccacacatggatggagaatttctgtatcatcatcgtattggctattgtagagaatcatgtgatataacactgtatgctatgcgcgcttgtggcattccagttgcaactgaattcttcagatattctcccgagtatcagcattatcatacatggaatacattacgggatacaacaggacgtttcattctatttgagcccggaaaaattgatccaacacgagataagataactacggataacagaaagaaggggaaagcatatagatattgttttggtgaacaaaaatcaacggctttactacttaatgtaaaggatataggaatacctaaatttttcaggaattcctatataagagatgtaactgccaattattttggtgaaaacgaggtgacggtacctatacaaaaagaagaacgatatatttacttgggggtatttcgtccgaatggatggatacctgtagatatggcgataagtaacggagataaggtgactttccataaccttgagcctaatatcatttatcaaacgctcattttcgatggtaagcagttgcatccggctggctattcgtttattttcagaaatggcaaggccgagttgcttgaacctgacaggataaatagagaggaagctgtgttgaagagaaagatgtctatcaaaccaactatctccgaatggttatatagatcaaccagaggcgctaggatagaagcagccaatgatactactttcagacaagctgatttattatatcagattaaagattcgtttacaactaattattatgagttctgtccgttgcattcgcatcagaaatataaatatattcgttatgttcctccggtaggcactagagtcgagttggcggagttggctttgtatgaagatactttaggtaaggcgaaaatttctatgcatgcgatgacttctttgaaaccgattgacaagatagggaacattacagatggtaatattctaacttattttcaggcaactgatatgacatccgctattacttttaagttagaaaaagaatcttccatcagtaggataactttttctccccgtaatgatgataattatattagtccgggcgatgtctacgaattgttttatcaagatggagtgtctggttggcaatctttaggaattcagactgctgttactcgggaggtccgttatattgtaccgaaaaatgcattgttgtggctcagaaaccttacgaaagggcgggaagaacaaatatttatttatagagataaaaagcaatattttacgattgatataactactgactcatttaatcgcaataaaataaatgagtgaagaaaaaaatgactgtacaaactgatctgtatagcccattagaacataaagttgattcaacttgctatgtatgggataatgtacatttgaataagagcggttcgcttatattggcggagcatatatataaagctattacaggtaaaaaagctcctaaattggaaaatgcatttgctaactagaagaaaaatcatactataaaacgacacatgaggcgatatatttattttgtttttttattatgttgtgctgttaatctattgttaactagttgtgtacgacagaaatatgttgtaatggatatggtacaccataatccgggtgaggctatgacggaatcgaagtttctcgatccttcttttttgaagaaaaatgaatatggagcaaaagtttttttcttgtttgaggctgcacagtttggaattgattggaagagttttgatccttctttattcccggatacgactgaagccggacgttgggtggcagaaaaagcagaaataatacataaaaaatatgatgcagcaaaaaaggaagaccttcaagtatactgtatgcttgatatgttagtacttccttctttgctggtagaaaaacatagaacagaacttactaacgaacaaggaaaacttgatatatcgaaaccttacactcagctttgtattcgtgaattgatgaaggaaatgtttgaaacgtttccacaattggatggattagtgattcgtactggagaaacttacctgcacgatgctccttattatgtaggcaatcatccagtacaaaatggtatgtatgatcatattacgttaattaatttgttacgggaagaggtttgtgaaagacgtaataagaagttgttttatcgtacatgggatatggggcaattgcattcgatccctaaatattatttgtccgttacagacagtatagagccacatccaaatctttatttctctatcaagcataccatgacggatttttggagatcagcaattactgatcctgatatgaattataatacaatggataaatattggttggaagaatcaggacaatatggtgttccttttaatccttgtataggtattggtaaacatcaacaagtagttgaagtgcaatgtcaacgtgagtatgaaggaaagggagcacatcccaattatatcgctaaaggagtaattgatggttttgaagaatttaagaaatctaatataaagaagccgtattgtttaaaccaagtgaaagataatcccttatttaagggtgtttggacttggtcacgtggcggtggctggggaggtccttatatcaagaatgagttttggatcgaattaaatgcttatgtcatctcacattgggctagtaatcctttgaaaacagaaaaagaaatactatatgattttgtaaaagcaaaagggcttcccgagtcagaatgggagatgttccgtcgactttgcctattatcagaagatggagtgataaaagggcaatatagtactatgggagatacttatgttaattggacacgtgatgacaccataacgggagatgtatatcaaaagagttattttgatcgtatgattgaaagaaatcaagtaaatgcttatctgaaagaaaaggaagaagctgttcgtatttggaaggaaatagaactgatatctcaaaaactacattttccctcagaagaattgaatcattttattcgtatttcctgttcgtatggacgcattaaatatgagctttttgctgtttcgtggcagattatgctatgcggttatgtggcagatacaacaaaaaagtcttttaaccggatagagatggataaatatattactgcatttgatgatttgtggaaagaatggaacgacttatctctagaaaacgataattgcccttcaatgtataagatttcttctaacttttttggttttcctgtaggtatacaagagaccattgataaatacaggaaatagttttcattttttcttcttatatgttatagaatataaaaaaataaatgaatattacttattgaatatattaattaaataaagacttactatttattgacataagtaatacctttccaatcatcagtacggaaaggagacattggcagatccgcaccgttatacatattgcatatcggataatcagcccatgcataacgtactgcaaccgggagggtaacttcagatgaggaaacaacaactgtatttccttcgatcacagcatctgcccaatgaaatttatggtctacaccagcaatggtaaatcctttcggcatttcgccattcgccgtcttcagaccaccatcaatatgatcaaagaagatacgaattttatttccttcaatcttataagatttatatatcggaccggaataaggaatcttctcgccataagtctgcgcccgggccgctaatgccaagcgtctacccacttcttgcttgttcttcggatgaatatcaaactcctcacctatatcaattgccacagccatacctgtattttgcaaatgtaaagtccgagtttgagcttctctcaattccgcccaagtagattcaacaggagctgtttgtttcgctgtaaaactagctaactgcaccatatagaaaggaaaatcatatccccagcgatttctccaatcagtaatcatcaacggcattaaatcacgatactgaaaagcctctcccgcatttgattctccctgataccaaatggctcctttgatagcatagggaatcagtggattaagcatagcattaaataagaaagtaggagaattcggattccatgacatatcaacaggcattggtgcaacctctctcatatctaaagaaacctgatatttccaattaccagccaactggatagcttctgtatcggaaagatgaagtgaaatactttcaggacttccattgataccaccagtaccaccagtatccattacacgtacagcaatcaccgcttttcccttcttcacaagttctttcggaatcttatagcttctaggtgccatccatccttctgtatgtcctatctgtataccattgaaataagtaaaatcattatcatcaataacacctaaattcaagatcaaatcttttcctgcccaaccagcaggaatatcaattgttttcctaaaccaaacaagcccactaaatcctggtaaatcttgttcttgcatcaaacctggaactttcatagatttccatgccgcatcgttaaaatcaggagctgcccatatagcctccccattaacacaccccttgtcaattctttcaacttcagctttccaagtctcaacatcttcttcaaactttttcttgcgtccttcctgagatgcaggcaaaccgaccaatgcttcgagtcttttcttcatactcggtatagtggatagtgcctcattactggtccatgtttctataattgttcctccccaagatgtatcaatcaatcctattggcacattacggtatttattcaaatcacgtccaaagaagtaacctgctgcagaaaagtccgctacactctttgatgtacacacttgccaaccattctcttttactgtaatattctcaacaggtgtaggactcatcgcattttctaccaataagaaacgaatattaggataattatttgcctcttctttctcctgttcatagttcttcaccttaccccaaccttctacctgcatttccatgttggattgtccggaacatatccaaacttcaccaatcattacattagaaagcttcacctttttaccatcagaaattgtaatattataaggaccacccgctactggggtagcaactttcgtactccacttcccttgtgcatcagcctgaatagtatattttttctgatcccatgaggtcgtaatttctactttcttcttaggcttagactcgccccatataggggcttgcgtttgttgctgtaacaccatattatccgaaaatatcggaagcaatttcacttgtgcagagagtgtagcactccctaatagaaagaatagagagattacaatggcctgcccgtcaaggtcgatcaaaagaaccttgtaccctttttgacgtaacgcaccgcccaggttgatcgtggttgtggtctttcctactccccccttgtgattcaatacggagattacttttgctttgctcataaattcagttttttaaatggttgtcatgtccgcaaatatagttaaaatactaatatactaaaatactaaaagtagtatttttcgttttttgcgtgttttttgtgccgatcggggaagcgtaccgaaataaatcctgtttccgtctttcggtacgttttgtttctgtaccggaattaatcaaagattagaataaccataaatgtttttatacgttaatcatacgtatgtatatatgtatatatttgtttttgagtatctttgtgtgctataaataaaaaataaaagacatgagcacttattcgtataaaaatccgaagtttataaattcccctaaaggggtggttgaagttgtagaagtgatttatgacggcaaagatgatccggcctattcactggctattattaaatgggaaaatacctataaattaggtattcgttggaacatcgcttatagtgaatgggacgattaccgcaaacagaacgggcaagatgaatgtataggtaatccacagtcgagaggtattcccacctggtttgttttgcccgatgatatgatgtttggtgagaagttcagcggtgcgatgcagaggcttgatgaattaagaaaaggtaagtaagcaatggaacagggagaaatcatattataccagccggatgaagcggtcaagttggaagtgaggttggaagatgaaaccgtttggctgacacaagaacaaatagccgacttgttcgggactaaaaggccagctattaccaaacatttgaacaacatttacaaaagcggcgaacttgatatagatagcacatgttccattttggaacatatgggtaatgacggcaaacagagatatactactaaatattataatcttgatgcgattctgtcaataggatatcgggttaatagcaagaacgcaaccctttttaggaaatgggcgaatagtgtattaaaggattatcttttaaaggggtattccattaataaacgtttgtcagaacttgaaaggactgtcgctcaacataccgagaagatagattttttcgtgcgtactgccttgcccccggtcgaaggcattttttataacggccagattttcgatgcgtacaagttcgccaccgatctggtaaagtcggccaggcgttcgatcgtgcttatcgacaactatgtggacgaaacggtcttgctcatgttgagtaaacgcagcgtcggtgtctcggccaccatttacacacagcgtatcacgcagcaactccaacttgatcttgacaggcataacagccagtacccacctatcgacatcaggacgtaccgggacagtcacgaccgtttcctgatcgttgatgaaacggacgtgtaccatatcggagcctcgttaaaggatctggggaaaaagatgttcgctttctcaaagctggatattccggcggctgtgataactgacctgttataatatcccttgtcttatgaatgtggttatctattcacgtgtaagctcgcagtcggccaggcaatcgaccgaacggcaggttgtcgatctggagaggttcgcagccggacgggggtacgaggtgacggcggtctttgaggaaaagataagcggacgaaaggccaatatcgaacgcccggttttaagccgttgcctggaatactgcacagatccgcagaaccgggtggatatgctgttgctgaccgagatctcacgcctggggcgttccaccctggagatactaaaggcactcgatacgctgcacacgcataaaatatgcgtgtatatccaaaacttgaacctggaaacattacggccggacaagacggtaaaccccttgtcctctctgattactaccctattgggggaactggccgcaatcgaacgccaggggatcattgcttttatttaataatatcaagttgatctcctttttattgacgatacaagataagagctgaagatgctgtgatagaaatatcccctcccgataaatgctcctgactgtctagatcaatttgtccgttatggcagactataatccaatcttgttccgggatattgatatctgcctgattccggttaccgttgtatgcaaccagaatttctttccattcatcaccgttagcatactcgcctagagtataagcgatgacaccggaatcgcctgtatcaagaaaatgaagccatttctctaagccctctgctgtaggaatacggaaggcgggatgttttttgcggagtgcgattaatgttctgatataattgaatatatcacggtttttagcttttaacgcccagtctatttggttgacggcgtcagaagacttgtagctgtttggctctccctgtttgtcctgcatgatttcttcaccgccacgaataaaaggaataccttgcgaggttaaaagcacggtgtgtattaatttgtcaataggaaccagttcttcttcagaatgttcgccttgaacagataatttcagcttatctaccagcgtatatccgtcatgacaggaaacaaagttaatcatttgagagggagcagcggcatatggaccgtcacagtaaagtaacccgctataatctacctgtgggtgttgtgttccgccaacgattccatatttgacaggttcaaaatgcccgttgatatttccggaggcataccctggttcctgttcgtcaaaggtacttcctttcagaccgtcacgaaattcatcattaaatacggaaatacctttcatttttcgtacattctcctttacagcccgttgctcgaaaggtaatggagaatctgctgctacccaaccttctccgtatacaaaaatggtggggtcaatttttaataattcctctcttaactggttcatggtgtcgatgtcatgtatccccatcagatcgaatctaaaaccgtcaatgtgatattctttcgcccagaatttgaccgactcaatgatataatggcgaaccatttcgcgttctgaggctgtctcatttccacacccggaagcatttgaataggaaccgtcgggattctggcggtaaaaatatcccggaaccgttaggtcaaaattagaatgctcggttgaggctgtatggttataaaccacatcgagtacaatacgaaaaccattttgatggaggctttttaccatctctttaaattcgcggatacgggtggtgggggtgacaggatcggtggagtaacttccatctggtacattataattcttcgggtcatatccccaattgtatttgtttttctccaatttcctttcatcgattgtggcgaaatcgaatgaaggaaggatgtgtatatgcgttactcccaattcttttaaatgatccagtccggaagattctccttcgggagttttagttccggtctctgtcagagcaagaaacttccccttatgttcaattcctgagtttggatcaatactaaaatcgcggtgatgaagttcataaagaatgatatcggaatacattttcagttcgggtgactggtctgattcccaaccttcgggatttgtctcgttccagtcgattacagcagcgcgattgccattgatgccgactgcttttgcccagataccgggtgtttcgtccagccattttccatctttttctatctggaaggtgtagaaagaacctttcagatcacggtctatatggatacaccaggtcccattgtcggctatgtccatttccagttgttcttccggatctcccgcttcgccggatgaatacaggtttaaacggacattatcggcacttggtgcccatagcgtaaatatggattgctggggtgtatagactaattccaaatcgttctcataatagcacggatacttgtcatacgaatccaactggtccggggacggatgatttttcaactctctcatattttctaattttatattaatacacttaacaaataactattatgaatacaatcaaaacgcttctattattatcatttagcatcctattatttaactgtagtgatgaagaagataagaaaactgaaaaagagtttatctttagcgcaagtgaattaaaacaaactgaatgggaaggagaattcctttacctaacaaatggagaaattgactcaaaaggatcgataaaaatcgttttttatacagaaaaaaaaggtgtttgtgagtataaatttgattatcatattgatcctgagacaataagttttgaatatgaaatcagtgacaaatttatgtacattgatggtcctcttcctattcatggaaattggatacaacaaaaatacaacggaaattctctagaaattgctgatagcaaagcggcttttaccaattctcgcatgataaaattaacgagagtcaactagtaaaacctttttctactaacaattaccattccaaggaaatagcctgaaaataggagtcttacatctgtctaatagcagatgcattattcctttttattactatcaaaatcttcttattaataaaattcaccaaagtatcaaccataagaaacatgaaacaatctaatatctccgcaacaataataatgtcaataatatcatttgcatcctgcacaaatgatattgagaatctcgacattattccgacaaataatggacaaaatacagaaggcaacattatactacaagaaagaaatccaaatcttcccttacccttaataaagaagttcatattaaacaagccacaaaccagaaatagcgtttcaggcgaagacagaaccttccttggatacagttataaaataaaaaatggggattatatacaaggaagcataaatagtttaggctttccaataatagacattgactctataagaaaatatagaccttcttatctacaagagaaacttataactgtaacagagactaatattttcacttataataatctcgacaaatacttgtatgattcaagatttggcaaaaaggtatcatctgagtttactttcaatcctaaagttttcgcaacagaaaaaaaggaagcaatcacaaagttattcggtaatatagaaaaagctacttatggtaaactcgaagtttcttttctaaaagggcaatccacattaaatcatttaccaagttcaagactatggtatataagccaatttcagaatcatattttcacaaatatcctatataatgccccaatggcatccatacttaacgaatttggtgaattcatattaacagattattttacaggaggaaaggtttatgccttattcgcaagcaaagccaaagaagggacaaccgctcaacaaaaagaagatgacatgtatacttctataaacacttcagtaattaacctcaataacgctactagtattaatttaggtttcaacggttccaactttgacgcaacaaaaacctttaaaagtacagatacttatttagatatgaaaacatttggaggggaagtaagtcaaagcgtagcaataaatacaaaagtttctaatatcaatatagacttaacaccgtggagatattctttaaaagacatggctaacaatacaatgatagatatagcagacaatagcctgtatcctctatcagcctttgtactcgagcaaaatttcaaacaacgccttgatgacaccttcaacgagatactacctgcgaacaaagagctagtacctccacgcattgaaatcgtgagagttctcgcccgtacaacaccttccaatgaagctctttatgatgtagcagccgttttagttacaaggcaaacagatagaataatattgagtgacgctatggcgtcatccgctacagatgaagaattaagaaaaaatgagaacaatgaagttttcatgcagaaagtagaaaaaatagcaactgaaaaatctaagttttttagttctgacatagaaatatcatataataaagagactaaactgaatcctactttaaaatcaccattatgcatagaactaacaacttatgtttcgtaaaagagtatttcctaatacaagggacaacaacataatggtaggtggacatgtggaactcgtattcttcccacagtttaaatacataataccaatatgtaaagagtgtaatgataaaaagcaaaatctacgaccgtttaaagttgaattagacagattgtgtcgggctccaagagagtaggtattaacctactctttagcctctatattactctctaaacattcatcaaatacagtattaagtacctcatttgcttgttcctctgttattacgtcattattaaccatttcatataataacatcggtattagttcttctgccatttctacatttaatttatatccttccatattaattcatttaatattgcctttactaattaatccttctataatgaagtctcttattgtatctagatattcatctacttgcttctccacatactcacgtggaaatcctcctccaaagttctcattacctgctatattaatagtatagctacattctccattatcttcgtatggtggaagtaaacggtccattacaattctaagagacgcatcatatacttccaatactacttcaccgcttttaaattcacgtttcataattccagttattaatccattgcctccatttccattagtaataaccactttaaatcttcatcttcaagcttatctatgaagccataagggtcttcccaaaactcctctttgggaatattatattcttctaatgtcctattcagtgtctttagtaacataatcattggttttatttaaaattaccggagtgccaatcatagttgaccacttcgataaccattacgttccttatctataatgtgatacatcttctcaaatgtaatttctatcgcagacatatcatagctcttaataactccttcattagaaattactctcacttgtaacgtgtctttgtctgatttatgagatgttatgtggtgagtacgcttcttatcaaattctggagtaaatatatctaattcgtttctgaaatgggaattattaatataatctactatgtagctataatcactaatagaatggcatactcctataacttcttgattgcagtatatagacttctgatattcagcaaacattattttaaagctatctacagtatattccttattcgcattatagaactttatacgtgcaatacttccgtctgataaatcagacagtttagtcattcttctttgtggtctgcttatccacatttcttccattaaatccataaattgttcctccgatttaatgtattataatcccatatagaatgctagcataagctttgctgcctgattgtccaacttgtcaataaatgctttagggtctttccaaaactcctctcttgataatccgtactcatctagtacagaattaatcccgtttctccactgttctgctgttatcatatttgttcattttagatatagttattcatctcatatctaatcctcatatataataccgtcaatttctggtaaatatccgtgtataataccttctgcttcttttatgagtacctcttcatagctaaagtagatagacctacgcatataaccatgattgtatctttctactaagctagtgagtagtattatttcagctttagatacttctttaggatttacacctaactttattattaaagtctctactgtcatcatattaacaattactactaggtggtatataatcatctggtacatcatgcggttcacgtgggtctgacttccattcactaatagttatctctgctaatatgtcattcactccttcttctgttaattccccagaatcacatttagcacaaagctcatctataagctctatgtattcattcattgttacctttctcataattcattcctcctattaatgctgtacctactgcgttctacaccttctcaatacacgccttataagtaaatagaatagtagtatagtgatagtaactaatagaacatcttctacttggcatagtatataatgttgttatacattaaaaaaataaagttatgagtaaagtagttgatttattaggagataagaccagttattatctggatcatacctgtaagaccattgataagtcgttgatttatataccctcaccggataccattgataaagtctggattgattcggaccgaaacattaaagtattgaacagcctgcaaacccttttagggcatggacgtctggcaaatacgggttatgtgtccattcttcctgtcgatcaggatatcgagcatacagccggcgcatcctttgcaccgaatcccatttatttcgatccggagaatattgtgaagctggctatcgaaggaggctgtaatgcagtagcttctacatttggtattttgggatcagtcgcacgtaaatatgcgcacaaaatacctttcgtggtaaagttgaatcacaatgagctgctgacctatccgaatacatacgatcaggtattatttggtacggtgaaagaggcttggaatatgggagccgtagcagtaggcgcaaccatttatttcggttcggaacagagtcgccgccaattggtagagattgctgaggctttcgaatatgcccatgaactcggtatggctaccattctgtggtgttatttgcgcaatagcgatttcaagaaaggagctattgattatcatgctgctgccgaccttaccggacaggctgaccgtttgggagttaccatcaaagcggacattgtgaagcagaaacttcctaccaataatggtggtttcaaagcgattggtttcggaaagacagatgaacgcatgtacacggaactcacatcggaacacccgattgatctctgtcgttatcaggtggcaaatggttatatgggacgtgtcggattgatcaattccggtggagaatctcatggggcttccgatttgcgtgatgcggtcattacagcagttgtcaataagcgtgccggtggcatgggattgatcagtggacgtaaagccttccagaagccgatgaataagggtgtcgaattattaaacgctattcaggatgtctacctcgatccggcaataaccattgcctgatctaggaaagatgagaaataattcttatctttgactaccagatagttaaccattaaaaaatagaattatgaagttttttattgacacagccaatttggagcagattcaggaggcgtatgacctcggagtacttgacggagtgactaccaatccttcgctgatggcgaaagaaggcattaaaggtacggagaatcaacgtgaacattacattaaaatatgtaagattgtcaatgctgacgtaagtgcggaagtaatagcaacggattatgaagggatgatccgcgaaggggaagagcttgccgcactcaatccgcatatcgttgtcaaggtgccttgcattgccgatggtatcaaagctatcaagtactttacagaaaaaggaatccggaccaattgtacattggtattttccgtcggacaggcattgctggctgcaaaagccggagcgacttacgtttcgccttttgtcggacgtctggatgatatttgcgaagacggggtaggacttgttggtgatattgtacgtatgtatcgcacctatgattacaagactcaggtattggcggcttctatccgcaatacgaagcacatcatcgagtgtgtggaggtgggagcagatgtggctacctgtccgttgagtgctatcaaagggttgttgaatcatccgctgactgattcgggattgaagaaatttttggaagattataaaaaggtaaatggataatcggatttgagaaactaagttttcttcaaagttatattgatagaggcttctgacataaatgtatgttagaagccttttttagttattttaataatgtcaaacaacataaaactaagacttctcgtttattcatcttaatttgtatcgtgtaatctaactagtgatgtaaataatgaataaaaatggatttagtcgatgtgccgatatctatatcggccgtttgcgagaggagggccgctattcctaattccccatcggagacaccgtaaggattggtattgacagcttcataatcacaagctgacatagaacaaagtgccaaaagcagaattatatattttttcatattcaattcctttatttattttagaatccaaatttcaaactcaatccataagtagactggctgggtaacataaagtaatcgtatccttgaccaaaagtaccagtggaagctgttagttcaggatcataaggggccttattgtatatcatccataaattagtaccgtatactgacaagctcaaattattaacagttcctttaaaccatttattggggaaagtataagtcagtctggcttcctgcaatctcacattagttgctgagtatgtatagtaggcatccaaattagaaactgcatcataataagtttttggatcaactttgaaatatcctaatgatacaccacctgcatcacgtgcatctgctgatgcttcagatactccatatctgtctaacatagcttgtgttttagatattgcgattcctccaatacgagctgtgaacaacaagttaagattaaatcctttgtaactaaatccatgctgccatcccaaattccatttagggttcacgctacctagcttgtagggtgaggtggtttctgtagttaatgcctgacctggctgatagtctatataattatcaccatctctttttagccattcatttgcatatacagtaccaatttctcctccttctctcaaacggaaacgcccaacctgaatatccgttaaatctatcaaggtatttgttaccggattcaagacatcacgtgccaattggattattttatttttatttgtcgtcgcagtgaacgttgtattataattaaaatcaccaaatttcttgtcaaatcctaaacttaattcaagtcctctattctgaacattaccggcttgtacaaacatatattcaaaattactacccaatgtagctttcagtaactgattatatgtatttgaatgataatacgtaactccgaaagttattgtattattaaaccatttggaatcaagacctacttcataagaacgagttctttcagctttcagattggaaatcggataatatttaaaaggtttaaaggttcctccttcaagttcgtgagtgagagttccaggagttaaccctgtataggggatcggcgaacctacctctgtataggaagctctgactttcaggaaacctaaagttggctctaatttctctttaatattattgggtaacagttcagtaacgatggcagacaaaccaaccgaaggatagaaaatccacggatcatcactgtttaccaattgagaaggcttatcggctctccctgtcaaggttaggtataaggccgaattccatgataactcagcagaagcaaatacagcaaaatttctcctgcggctgtctccaccagtttgacttgcggtgctctgcgtcgggtctatattactatatacaaatttattcggtactaatagcaactgccctccatatccacgtccttttgtatcatattcttcgaaagaagttcctgcattgatcgtagcatgatagatttcagcaaactgtttatcgaagtttaccattatatctgcatatttctgtcgaaacgtctcgttagagtatgtatagcgtccgtttgtactagcatatgtgtttatggtagatgcataacgtttatcttccttttcagtataggtattatctaaacgtacacgacctgccacattcaaatagttggtaatatcgtactttaaagaggcatataacatataacggtcttttacttccggacgaatgttacgataggcaatccaatatggattttgtatatccatgccaaaatctccgggactccattgctgttgagaatatccgagttcactattatagcgttcaaaatacttctctttctcaaaatcttcaccgcgcggatataagtatgcgccaacaattggattaaaataagttccataagaaatcatattgttataatactcacgtatataacttgcagactaatatagatatgaatcttacaaaaacaacaaatttgtattttggaatggagggatggtttactgttaataaagaaccaggtaattctgaacaaaatgcaacagatgcagtgtggaatgctcaagcattattaactccattgactattccaactaaatactctacaggacagttaccttcgtatgggactcttaatgcatattcaccatatgtgatgattaatcataccggtaaaaaacaaactgaaaatagtaataatcagataacacttgctttaaatcaagatctttcttttataacaaaaggactgaaaatacgtgcacagggtgctataacaagaaataccaattattcagaacgtcgttatgtattgccagaaatgtattatgcaactggacgatatgcgaatggacaacttcagttggtaaaaaaacaagatgaagtaaaagctcaattttctaattatcagaatcagtattcaaagtatcattttgaatcaacacttaattacgaacgtttgtttggaacagatcatcgtttttcagctttggtgtattattatatgagttcggaaaaaaatttacaagatatagctaatgctgattcaaattttgaaacaatggctgcgatacctaagcgttatcagggagtttcgagcagagtgacatatgggtttagagatacttatctaatggacttaaactttggatatacaggttctgaaaactttcaaccggggaaacaattcggttttttcccttcatttgcttttggctggattccgactcaatatgacatagtgaaagaaaaatttccttggctggatcatttgaaactccgaggttcatatggacttgtaggaaatgataggataacggataaaaggtttccttatttgacgattgtaaatagtggagcacctctcggttggggaggaaatgttggaggaggtatttcagaatctgtaattggagctgataacttggagtgggagaaatcaaaaaaactagacattggaatcgaaggaaaattgtttaataataaaatcgattttgtcatggactatttttgggataaacgtgaaggtattttccaacaaagggcgcaaattcctaattttgtaggattggttagtcttccatatggtaatgttggtcaaatgaaaagttggggagccgatggaaatatttcatatactcaacagatcaacaaagatatgtcttttgttattagaggaaatttcacttactccaaaaacaagattgataattgggaacaaatagagcagaaatatgcatatcagaattttagtggttggccttatggtattcaacgaggatatattgctttaggattatttagagatgaagcagatataaataacagtccgatacaaacttttggaaattatgaggcaggggatattaagtataaagatgtaaatggtgatggaagaattgatatagatgatcaagtacctttgtcttacgataattatcctcggttaatgtatggatttggtggagaatttagatataaaaacttaacgttcaatattctttttaaagggattgggaaaaaagactttttttatacttcagaagattcgggctttggctattacccgtttttatatggggaaacaggaaatgtattgtctattgtggcaaattccagtaatagatggatacctgcttcatattcgggtgacccttctacagagaaccccaacgctaggtttccacggttaagttatggaaagaatagtaataatacacagaaatctacattttggaaagcaaatggacaatatttaaggttacaagagataagtgttggttataatttgaaactgaaagctttttctaaaataggagttagttctattgatttacagttagttggacaggatctttatgtttgggataaaataggtggattatgggaccctgaacagaccactaagaatggtcgagcttatcctattcctgcaacttattcattacaaatgtatattaatttttaattgtcagaatatgaaaaataaaataataaatgcgatgcatagcagctacaagtttgaataattatatatttactgatgttgcagagttggatattacagatttagatgctattcgtaatatgatacatttggataatataaaggtaattgttaactgtgctgcttatacgaatgtagataaagcagaagatgattatgatatggcagacttattgaataataaagctgtagagaatttggctattgctgcaaaagaagttaatgctactttaattcatatttcgactgattatgtatttcaaggtgataagaatatgccatgtggagaagactgtgaaactaatcctttaggtatttatggtaaaacaaaaagagcaggagaacaaagcatccaacgtgtgggctgtaattatttgatttttcgtacagcttggctgtattctcaatttggtaagaattttgttaagactatgcgacagttaaccgctgataaagataaattgagagttgtttttgatcagattggtacacctacatatgcaaaagatttggctgatattatttatagagtgattgagggggatcaatatcacaaacaaggtatctatcatttcagtaatgagggtgtttgttcatggtatgattttgctaaagaaatctgtgaattgagtggaaatagttgtgatattcaaccttgccatagtgatgaatttcctagtaaagtaaaacgtcctcatttctcagtattagataaaacaaaattgaagctggcttttggtgtagagattccttattggaaagattctcttgtgaaatgtattaataaagaaaataattaatcatgaaattctcaagaaatataatgatcactggtggtgctggtttcattggtagtcatgttgtccgtctgtttgtgaataaatatcccagctatcgtattatcaatttggataaattgacttatgctggaaacttagctaatctgaaagatattgaagataagcctaattatgtttttgtaaaggctgatatctgtgattttgaaaaaatgatagagttgtttagtgagtataagatagatggggttattcacttggcagctgaaagtcatgtagatcgtagtattaatgatccttttacttttgctcgtacgaatgtaatgggaaccctttctctgcttcaagcggctaaattaacttgggagtctctttctgaaggttatgaaggcaagcgtttttatcatatatctacagatgaagtttatggtgcattggatttaacgaatcctagtggcaataaggacggtaggggaccttatggtcatgatttttttaaggaaaccacgaggtatagtccacacagtccgtattctgcttctaaagcaagtagtgatcattttgtacgtgcttttcacgacacttataatatgcctacaattgtaacgaattgttccaataattatggcccttaccaatttcctgaaaaacttataccattattcatcaataatattcgctgtcgtaaaccattgcccgtgtatggcaaaggagaaaatgttcgtgattggttgtatgtaatcgaccatgttcggggcattgatcttatttttcacaaaggtaaaatagcagagacatataatattggtgggttcaatgaatggaagaacatagatattattaaggttcttattaaaactgttgataggttactaggttatcccgaaggttattccttagatttaattacatatgtttctgatcgaaaggggcacgatctacgctatgcaattgactccgctaagctgaaacaagagttaggctgggagccgagtttgcagtttgaagaaggtctcgaaaggactgtgagatggtatttagataatgaggtatggatggacaatgtgacaagtggtgattatcaggagtattacgattccatatataggaatgaatgaatattctcttttatatagagcctttttattcacataataattaaagtactaatatgaaaaatagcttttgatgttgtaaacatctaaagttggagttggatacgaagttccggatatttactgaataattgttttatatttgataactactaattatcaaaaaccttatactttttatcctaagagtcttttgtattataaaaatatgaatgctttattttgttatacaaattatgcttttcatagcttactgacagattgggctaatgataatgaattctttagattgatgtggcagaattattatgaaaatgagtctgctaatgttgatttgaagaaaaagtttgcagggatattctcaaatatcgtagttacgggcttgcctgtaacagacttatttctgactgagaaacatgaagataagtggaaaaaaacagataagagtcgtaaacggattatttgggcaccacatttctcaatatctgatggtggctgtttgaactattcaactttcttatctattgcggaagaactgttagaatttataaagaacactcaattacctgttcagatggcttttaagcctcatcctttgctaaagagtcaactatataattattcttcatgggggaaagagaaaacagacgagtattatgcggcatgggaatttctgccgaatgctcaattggagaccaatgagtatgttgatttgtttatgacttcggatgccatgattcatgattgtggctcttttacgattgaatatcatcatacattgaaacctgtaatgtatctggtcaatggaaaagagcatactgcaacgatgaattcttttgccaaggcagcctatgacctgcattataaggggcagactatccaagatatccggaattttatagaatgtacagtattggaaaactctgattacttactagaaaaaagaaaaaacttttttaagtcgtacttattgccgccccataatcagtctgccacagaaaatataatccatgctattttgggaacaggatattataccgaaaaaaaacagaggtgaatagtgatattcgttcaatgggcatttccggtgtgaaatgggcttctataggacgtttctcttcgcagggaataagttttgtcctgggacttattttggcccgtctgcttttgccttcagactatggtatgttaggaatgcttggagtgtttactgcttttgccggttcatttatagattgtggatttggttctgctttgatacgtaagttggaccgtacagagatagattgttctactgttttttattataatctgggagcgagtttattggtatacatggtcatgtttttgggagctccttttatcgcggacttttataagcagcctttattgactaatgtaaccagaatagcctgtctgacaataccgataggtgctctatgttcagttcatagtaatcttttgtattgtcagttgaggttcagagatatcgcgataggtaatatactggccacttttttttcaggaggtataggattattattagcatataatggttatggagtttgggcattagtatgtcagggaattattgcgtctttggtaaattgttgctatttatggagaatttcctgctggaaaccattgtggatgttttctaccagctcttttaaagaattgtttggttatggcagtaagttaatgttgtctggttggcttaatacaatgtattctcagttgtccccgttgattattggacggttctattcttcctccactttgggttactataccagagcgcaaagttacgtggatttcccgagtagtaatataatgggaattttgcagcaagtcgtttttcctgttctgtcgagattgcagaatgaggatgaacagttaataggaatttatcggaaatatattaaagtttgtgctatttttattttttgtggtatgaccattttggcggcactggctaaacctttgatacttcttttacttacagataagtggttgccatctgtcccgatcatgatacttttatgtttttcttttatgttctcatttgtgaatacaataaatttatctcttttacagattaaaggaagatcggatctatttttgaaactggaggtcgtgaaaaaagctatttctataacaatgattttgttgagtgcatcttggggaattatggcgatgtgctggtctatggttatatatacccaaattgctatttttattaatacatattatagatattaaagaatccaaggcttattttaatttttatattatcccgatattgtcattggatagatgataaaacatacttatgtattatgtattttatctattttggcaaattgttacatcttaactcacctcgtacttttaatgaaaagttacagtggcttaagttatatgatcgccatcctgaatatacgcaaatggttgataaggcaactgtaaaagaatacgtagcttctattattggcgaaaaatatataatacctaccttgggagtttgggaaaattttgatgatatagatttcgagaatatacctagtagttttgtcttgaaatgcacacatgattctggtggagttgtaatttgtgaaaacaaaaatttgtttgacgttgagaaggctagaagtaaattgttgaaatctatgaaaaaaaactattattatgttggacgtgagtatccttataaagatattaagcctcgtataattgctgagaaatacatggtcgatgaatctcatatagaattgaaagattataagattcatttgtttcatgggatacccaattttattcaggtagattttgatcgttttactagtcatcatagaaatttgtatacaatagattggaaaccacttgggaaagctataaaatatccggcagtttatgagcgtgagatcgataaaccaattgttttagatgagatgttagagttagcaatgaaactagcttttaatattccttatgtacgggctgatttttattgtataggaaataaagtttattttggagaattaactttttaccatgggtcaggatttgaaacattttctccaaaatcttttgatgaagaattaggggccttaattaagttatcataatgaagattaattctgtttatttagtttctcgattgataaaatcgggaccaacgaatcaagctttgaacttactttcaggttttgataaaaagagagtaaatgctgttattgttacattatcagaagaggactcattttcgtctatgcataaggaattcatagaaaaaggtatagaagtggtccaactaaaaagaaaaaaatggaatctgttttttgcattgtttgatgtagttaaattagttaaggaaagaaatattcagttagtgcattcttcagggttgagaccagacatattaaatattttattatggaaccaaaatgttaaaaaatgtacaacacagcgatgcgatcccaaagatatacttaatttctactcaagtactatcgtaagctttatttatgtattggtggtacgtcgttttcaccgcatcattgcttgttcagaagctctgtcgcgtattttgcatgaaaagtataatttaaaaactacctttgttcgtaatggtgtagacacgactatctattatcctttatcacgtgatgagaagattgcattgagaagtaaatataatataccggatgagaagcgtatttatgttgtgttaggttcgttaattcatagaaaaaatgttttacatattattaaatcatttcatttgattcataatgatgacgttcatctattgattgtcggagggggaccacttcaaaaagagctggaagaaaaagccgctggattaaatattacttttacagggaatgtagctattccgcttccctatattcaaatgtctgatataatgatatctgcatcattagcagaaggacttcctaattcagtgttggaaggacttgcatgcggattgcctatattattttcagatataactccacatcaagagatatattatcgtgatactgctataggagaattgttttctaatgataaggtcgagtatttggtcgaagccgtacagaaaacatttaaatgggatttagaagaaaaaaaaagagttgtacgcgatatggtggagacaaattttagcaaatatgtcacggctagagcttatgaagaccaatatatatctttgatttcggaatgactattttttattattcctttattatattggcgttattagcttgtttaacggtgagttttcgtataaaaaaacaacaatatcttattttatatttatttgtgatcgtattgttatcattattggctggactgagatatgataatgcactttcacgataagcgagaattccatctttcgacgcttctaaccaactttgtgttcttagcatagggtacaaatcaaatcctaagctcgtatttatttttactggttttatatttatagtataaaaaagataagcctgccaagctctatcaagattatcaaacgctattactggcaactcatagttaccattaaaattttgattatcttcaaatgcccataatcgatgctgtccatcaattatctctataggcttaagttctggattccagtcatcactaaatacaccttctggaatatttaatattgggaaaggaacttctttagcattttcccaagcatcttgatctttcaacctgtcatctattgtgagacaatttctagcttctagtattttcccattccttttttcattaggagaaagaatattaataatgatagcagtaggaagcaatcctggcatttttaatttagcatgctctactgttctttgctgttctctagtcaaagttgaccatgggaaccctccttcaatataatttgttatttcctttacacgagcatcgctcttttttctttgaatggatgtcctatcttcactattcctcctatgaacatcagatagtcgttttaaaagacgagcatctatgctaaaagtataaaagtacggtttaggttttctcctcaattcctctgaattaaaatttatatcatcccattcattcatccattggttaaccctaagcataggtaatcgagaataaaccttcaaattactaatggaaaaaacgtcttttttagggtctaatgattcacctaaagtccatttcttaaactgttccttatctaaggataaagcatcaataataaatgacttgtcacaagcttcccaaaacaattcttgatctgctactagctctgcctcattgtacccaataacgcatagcctatttatgaataattctttagctaataatcctacattaccatcttcaaataaggtagctaatgtgtacggtacttctttttctcttctataattttgtaaagctgcacctgacaagaccaaagcacttcttaggtttgtcgaaacctttgtattaggttcatatttgtaagtgccagtcatggatgattttgaagaaaatcgagctaataatttgagcaaagaataatgcatagataccgctgctacaaaagcaaatagcctaacttgtttagggtagttctgtatctctttccaaaaagaaggtaattcatcggacaaatgattaatgccaagaaatccttttagaacaggagtatcaattgcctttaaacctacaatgtatggttccaagtcattatctgctgttatatctatcaacttgacaatatcatactttgtccatgatgactttaactttttgatatttattttctcattcatgattattgtcttttatatgatatgattagttcattaactcccatagaatgaatatctgatcttcccattttactatgtatatattctttcacttgaatatctcctttatattgatttcccataatagagttgccaatttccataatttcatcttgagtaatcattccattatcactataacttagtattaaatgtgagttcttatttttgacacctttaaataacttaccaaatgcgtttttcacctctgtttttttcccgaaaggagattgatgtcgatcttcacgatatcgacctttatatttaacattcggataatcataccttatcaaggtttcaatagcatgataaaatcttgaataatgaacggagctataaggaggatcagcatatacaattgtatttcgttcaatcaaccttaagcaatcaagataatctaatgtagtaatagtatatcggttagttgcttccacgtctaccatatttaatatttccagaaatttcttttcaaaataagtccaaatatctcgtatgcgatataacattatatcatgcatattactttctgtaacatccctaaattgagcaaaatgtccagtactttgagatgtgtaggacatagcatatattaacgatgatagtatgatataataatcactttttcctttatactcttctgctactgcacgaatagaatcaatccagacgcattgtgtatagcgttactatattattatttgagcgtgcaaaggtagacatttaaaatgaattatgagctatccggaatgtgtcaatctggcataaatgtattacctttgccacgttttttggcaaaacggtcagattggcaaagtttttgcttgggaaattgatattatgaataaaaaataaaaataagatatggatccaaaagaaaaagaaaagatggctgaagagctgaatgtggaagaaacaaaggatacggcggaagaacaaccgcaagacgatcaggcagaagaggccgctcccctgactcatgaggagcaactcgaaaaggagctggaagatgctcaggctgtcatcgaggagcaaaaggacaaatatctgcgcctgtccgctgagtttgacaattaccgcaaacgtaccatgaaggagaaggcggaactgattctgaatggtggcgaaaagagcatcagcagcattctgccggtgatcgacgactttgaacgtgccatcaaaacgatggaaactgccaaagacgtaaaagccgtgaaggaaggtgtcgaattgatttataataagttcatggctgtcatggcacagaatggtgtgaaggtcatcgaaacgaaagaccagccgctggataccgattatcacgaagccattgccgtcatccctgccccgtcggaagagcagaaaggtaagattctggactgcgtacagacgggatatacgctgaatgacaaggtgattcgtcacgcgaaagtagtagttggggagtaaatacaaaagttagtttagttaagaagcatggcagaaaaaagagactattatgaagtgctggaggtgacaaaaaccgccacagtagaagagattaaaaaagcctaccgcaaaaaagcgatccaatatcaccccgacaaaaatccgggtgacaaggaagcggaagagaaattcaaggaggctgccgaagcgtatgacgtgttgagcaatccggacaagcgttcgcgttacgaccagttcggtcatgcgggagtaagcggtgcggcgggcaacggaggtccgttcggtggtttcggtggcgaaggaatgtctatggatgatatcttctccatgttcggtgacatcttcggaggtcgcggcggtggtttcagcggcggcttcggagggttcagcggtttcggtggcggtggcggtggttcacagcaacgtcgctatcggggcagtgatctacgtgtcaaggtaaagatgactttgaaagaaatctcgacaggagtagaaaagaaattcaaactgaaaaaatatgtgccgtgtaatcactgtcatggcacgggggccgaaggcgacggcggttcggagacttgtccgacctgtaaaggtagcggttcggtgatccgtaaccagcagacgattttgggtacgatgcagacccgcaccacttgtcctacttgtaacggtgaaggtaagatcatcaagaacaagtgtaaagagtgtggcggcgacggtatcgtatatggcgaagaggtagtgacggtgaagattcctgccggagtggcagaaggtatgcagctctcaatgggcggcaagggtaatgccggaaagcataatggtgtgccgggcgacttgctgattctcgtagaggaagaaccgcatccggacttaatccgcgacgagaatgatctgatctataacttgctgctgagtttcccgactgctgcactgggcggtgccgtggagattccgacaatcgacggaaaagtgaaagtgaagatcgactcgggtactcaaccgggaaaagtgctgcgtctgcgcggcaaaggtctgccgaatgtcaatggttacggtacgggagatttgctggttaatatcagcatttatgtgccggaagcattgaacaaggaggaaaagagcacgctggaaaagatggaggcttcggacaacttcaagccgagtacgtcggtgaaggagaagatcttcaagaagttcaagagcttctttgactagctttctttggctgggtctgtttttaagatcatagtcattcacacagagatataataaagagtgtgaattctaagtcctctccaaacaatatctataaaatcttacccaagtttacgaacattaacgtatccttgggtaagtttgtatatagacatacctactcttcagaagtgtatagctactaacagtacccatatccttatccttattcaaagagaataataaattgtgtatttgttcttcattgctaacaatataaatatatttatcatacaattcttctctaaacatggcatcttcatcacaccctatcattaacaggcccaaaacgaaagccatcattacttttatatattttttcatatcatatatttttagtttgcccatcctggattttgatccaaatctttaactcttcttatctctgtcctagaaataggcagaaaaatcatctttttattaataactctgtttcgcacacgtgaatgattcactataactctattgtaatattccggctcagcagattctatatccatccccgtgataggctcagtttccacctcttcatatattccccatctacgaacatcatagtatctgcgattctcaaataagaattctatcatgcgttcgtctataatctgttcttgcactttaactgggtcttccaattcttcattcgtcagtcctggaagcccagctctataacgaactcgattaaatgattttgctatctcatcaagatttcgatatgctgtatattcgaaatcgtcaggaagaacaactgtgaaagaagtattgcctagattatttaatgcttcagcataagataatagaatttctgcataacgaataatcggaaatcctttggcaactcgttgtgctccctcaccactccatgcatctgattcatgaatatatttcgttatcacataacctgtgctcggatagtcattcttcacattagcactactgtatctacctgaattaccatttttatcatacgtgacagttatatttttctttcttgtatcgcttgtagaactagccatccaataacgtcttgaaaaacctatagaagcataaaaacgcatttcacgattagcatacatattgctaataccagtattcaatgtataccctgagaatgtcattcgtcccgtattagtcattccatcttcagaataaggatattcagaactcgaattctgaatacttcgtccatccaccatcttatatttatctatcactttttgtggaacacacattccattgaaacctcctaaaatatctccattaaaagaatgtcttgttatatccacaatactactagacattcttccccaaatatattctgggtttgtttgtgggacagtttcccccgtaaacatatcagaataagatctgaatggatctataccacctgctcctgccggaaagggttcagttgacacaccttgtggcaatttaggagtattaatatcactttttactgtatgaagttcatacaatcccatatctataattcgtgcacaagctgctgctgctaatgcccatcgttccacattctccgtttgcgatatataatgtgcattgtcgacactccttttccatgaaccaaaatacgttttagccacactgcctccattatataacggactagcatgttgcaatcttaatcgtgcaatcaaaccatacgctgctccttttgtcggtcgtccaaactgactaataggtacagtgatcggaagatttactgcagcagcttccagttctccacacacatactctaccgattcgtcataagttgaccgatgagcattataataatctatagtttcattattatccatgacttcatcgcccagtatgacaagtggtccaaaatccatcaataaattataataagcatatgccctcataaaacgtgtataagcaagaagttctaacttttctgtcgtttttagatctttcgcttcatctattctacgaaatatcaaatttgtttttcgtataatcttatacatagttccccaatttcccaaacctccagaattatcaggagtgatttcacctaagacaaaccccatacctagaaattggtcactaccaaatgtagtaaaggcctcatcgctagctaacggacctggagtgtaaggatattgaaacaattttccctcatccggaaaattggctgctgttgcccataaatatttctccacgtttcttttattagcaaataccgaatcataagagagcatatctttaaactcatcttctacgttaagaaaattacatgaactcatacaaagaagcatgccaaactgtatgaatattattattttatttttcatattctgacaattaaaaattaatatacccgctacgctgttgacgagacaggatttcaatgaattcttctttactcattttttgcatagtcttttttctggcaaagatcgagacttaaagatacaaagacaacgggtactttatcgggggcttaccaagcaataaccttgtcagcattattacttttgaatatatcaaaggtatgctctcaagaagataaaaaaactaaagattttttcaattctggtggatatatatctgaaggatatgcattggatagaaaccaagtacgatttaatcagtccagcgattttgtgtttcatcatattcctaacggtaatctaatatgcattacttcaaaacaatttagagcacatgcatttagtcgacattataattgcatactatcaaaagacagtaattttattgcatacgtatctgtgcctcccatattctgcggggataaagattctatttatgctgactttagttttaaaacaggatttatgattgaaatgaatacttatcatttagaaataatcaaaggagatttttttaggaatacaggagaaagggttacttctttgtgtgatcttcctctcatttataaatcttcaaaatatgctcgtaaagcatttaatgcggatactgtaattacatatcctttaagaatgtgggaaaatttagaaaataagtacaatcattgccaagtaatgataattcaaaaaaaacgtcgtggatgtattgctctgtattgcttttataatgacaaaggtgccaaaaagctaagtcactatatcagatcattagaacatgtcttttggtatagagaaccgaaagattacattgaagtaatagatccaccaatcatagatgaatatgaaatacctcatttaaaagctaaagaaagatccgctaataattaagatgcaaaaataagatgggaatttatcctattacttctatctttacagaatcacacaactaaaatttatcagaatgattataatggctacaattattaaagtgtaaaacaatgagaatactacaaacaataatcttatcatcattattacttttgatagcatcgaatgcttatcctcaaaaagataaaagtcttcaaaatgtttttatcccagaaggttatgcactagatagaaatcaagtacagtataatcagcctaaagattttatatcctatatcgattctttaggaaaaaacaaagtttatttaggatgctttcttgcaaaagaatctaagagattaccaagctactatcgcaaatcctttctatccaaagatagtaattttattatactcactgctattcccagtatattttgcagacgcaatgattcagtctatgcagattttgatttgcttccagaaatgaaagttgagatgaatacttatcatttaacccatattaaagcggacttccttaaaaatacgggaaaacgagtcgcttttttatctgaattacctataacttataagtcttccaaatatgcccgtgaatccttcaatgcagatactgttatcacataccctttaaaaatgtgggaaaaatatgaaaataaatatactcattgcttggtcatattaattcaaaaacgatatcgtggttgtatccctctttattgcttatacactgacgaaggagctaagaaactcaaccactatatcaaatcattacaaaaggtgttttggtatagaaatccgaaagattatatcgaagtaatagatcctgtcccagagacagataatatatttattttgccaaagcgaaatgaatcagataccgtacgtatagttggtcaattatgaaaaatagaattatatcacttttcatatatttattgcctggtttgatctatgctcaaaataatgcagacgacaaatatgagattatgtctctaaccgacatgttgaatctttttaaggacagtatcaagacgtaccagcaggttataatggtataattgccgaatggttcactggcaaataccttgaatattgatattgagtcaacaagcaatattaaatcattgattgtctatgcaacaatgcgtttttatttctatatttgtagaatcacacaacttaaatttaatgcatatgaaacagaaattagtacgaataggtattagcgggatacagaaacaaaaagagagattttgccttatatttcctgtactattatttatatttatctttcccgcatcatctattgctcaaactatcgcagaagaatataatttcaattttaagggaggagaagaaaatcattaattaataaatttatatctatgtttgacaaacaccctaaaggactgatagcagccgctttagccaatctaggtgaacgctttggcttctatacaatgatggcgatcctcgtgcttttcttgcaagctaagtttggaatgaatggaaaagaagcgggatttatttattcaactttctatttttccatttacattcttgctttggttggaggtattatcgccgataagacacgaaactacaaaggaactattttcacgggaattgtgctgatggcagtgggatacttgttgttggctattccatccaagactccggtagacaataagaccttttatctggtcattacttgcgccagcttgtttgtgattgcatttggtaatggattatttaaaggaaatctgcaagctctggtagggcagatgtacgataatcctcaatatgccagcatgcgtgactccggtttctccttgttttatatgttcattaatatcggtgcaatctttgctccgtttgcagcagtaggtgtacgtaactggtggttgtctactttcggttataattacgatgctgatcttcctgcattatgtcacggtcatttggctggtactttgtcgcccgaagctactgaaacttatcatacgttggtagagaaagcttccaacgctccggtacaggattatacagcttttgcatccgattacctgaacgtctttactacaggtttccattatgcatttggagtagctatcattgctatggtcatttctttgactatctatttgctgaataagagaaacttccccgatcccagcaagagagccgttgcgtcttcagcatcttcggctactgtagaaatgagtattcaagaagtgaaacaacgtatgtatgccctgttcgcagtgttcggagttgttatcttcttctggttctctttccatcagaatggtttgactttgacgtactttgcaaaggaatatactgaccttaacttgtttggtatgcctatttccgcagagctgttccagtcgttgaatccgttctttgttgttttcctgactcctgtgattatggcaatctttgccagccagcgcagacgtggaaaagagccttctactcctaagaagattgcaattggtatgggtattgccgcattggcctttatcgtaatggctgtcggttcttattttgccaatctgcctttgcacaaggacattatcgctgtaggaacttcaccggtgaaagtgactccgttcttgttgatgctgacttatctgattttgacggtagctgaattgtatatttctccgttaggaatttcatttgtgtctaaagtagctcctccgaaataccagggtattatgcagggaggctggttaggtgcaactgcacttggcaatcagctgttggtgatcggtgctattttgtatgaatccattcctatctggatgacatggacagtatttgtggtagcttgtactatttcaatgtttaccatgatcttcatgctgaaatggctggaacgcgtagcgaaataagcccgcttggtaataaataaacgaatgccccggaacattgattgagtaacaatctgttccggggcattttgtatatggttaccttacttttcagatatccagtcccatgatataatcattcatatagtacccgttgccaatcggaaaatccccttcccgcaattttctcatacccatccgttcatagaacagtaaagccttgttgttacggttcacgttaagctccattaagcaaggttccggatgtacctccttgatatatctgacagcctctctgaataaaaaactaccgcagtgtgcgccttgaaaatgggggaggacatagattttctgcagatggaatacattctcttcctgttgctgtacggagacatagccacagggctcatctccttcatatgcgataaaataaacatgaccttcttcttccatttgtttccggatattttcgggagagtacatccagtccatcatatagtccagttgtccgggagataagatctcttggtaagtggcgggaaatacttcaccggccatttggttgatcagaccgcaatcatctatccttgcttttcgaatagtaaacatacgtattttcttttttgtggttttatgagctgcaaatatagctattatttctttttataataaggagaaaacttcttaatgatttaattattattaaattatagtactttgtaatgcaaggtactagagtaatgcatatatttgtcctgtcaaaagaattaatttattcaattttcctttgttaatcctcgataaatatgattgatatttctattattacggtcggtatgaaccatcttttataccttaaagtattattacgttctttatataaagagaatattcctcaagcaagtattgaaatgatttatgtggataattgttcatcagatggtactgttgaatatatccgacaaaattatcctcaagtaaggatcgttgagaatcaaaaacctttaggatttggagaaaataataataaaggagtattagcctcaatagggaaatatattgctattattaatccggatattgttttgcataaagggagtttagattttctatatgaatatgttgaaaagcatcctattataggcattactgtaccaaaactattgaatccagatgggacagttcaatattctgtgagaagttttattacattaaaagttctgttctctcgatttttatctaaaggtaatgatcaaacaaccagtaagatagtgaataagtatctttgtaaaaacatggatacaacaaagatacaacctgtagattgggctattggcgcagcattatttatgcggagagatttttatgcttttttaggcgggtttgatcagaattattttttatatatggaagatgaagatatttgtcttcgatcttggaaatgtaatcgtcctgtcatttattttcctgaatctataatgactcataaccatcttcgtggaagttctaaaatcggtcgaaaggcgcttcttcatttacagagtatgtttgttttctttaagaaacatggatgttcgattggaagcttttgttctaaaatgcaagcttgctcaaaactagaatattattagaagaataaatgtggttttatagaaataatattaaaatctattatataacatcgttctatgcaggagatccaacgttttaataaagttttaaaatcttgtgtcctttttggggatataattttgttgaattcattgctatggggatttgaactggttttgggcagtcgcttttattctggtaatttaacttctctttatcaagggatggttctgcttagtctatgctatctggtttgcaatattcaatcaggggttattttgcatcatccagttgttcgtccggaacagattatgattcgtgtacttcgtaatatggttccttttattttattttccatttgctttttgtctcttttccattttgaatttttccgctctcggttgttcggattgttttatgttgctttactgatcatcttgatttgttatcgtcttgcttttcgttattttttggagctttatcgtgaaaaaggaggaaatgttcgcatggttgtattggtgggcagtcacgagaatatgcaggaactttaccattcaatgacagatgatccaacttcaggctaccgtgtaatgggatattttgaagattccccatccgattattatccggaagaagttgcatatttgggacagccgaaagaggcgattgagtatttagaaagaaattcaggtaaaattgcacaactctactgtagtcttccttctgtacggagtgcggagattgttccgatcattaattattgcgagaaccacttggtgcgtttttttagtgttcccaatgtccgtaactatttaaagcgcaggatgtattttgatttattaggtaatgtaccagtattatctattcgtcgtgaaccattggaacttcgtgagaatcgtgttttaaaacgattttttgatataatattttcattgatattcttgtgtactattttcccttttgtttatataataatagggattgctattaaaatcagctcgccggggcccattttttttaaacagaaacgtagtggtgaagacggtcgtgaattttggtgttacaaatttcgttctatgcgagtaaatgcacaatgtgatgttcttcaagctacagcaaatgatcctcgtaaaacacgtataggtgagtttattcgtaaaacgagtattgatgaattgcctcagtttattaatgtattgatgggtgatatgtctgttgttggtcctcgcccccatatgctgaaacatacagaggaatatgcccaagtgattaataaatttatggttcgtcattttgtgaagcctggtataactggttgggcgcaagtaacaggctatcgtggagagactaaagaactttggcaaatggaaggacgggttagtcgtgatatttggtatattgagcattggacgtttatgcttgatttgtatattatttataaaacagtatataatgcatattagagcgataagtaaatttattataacctaatcctttgttatatttactgtttttatctattttataggcagcatcttcttttgacatccccagacttaaaaaatatttagctacactacctccacctctagcacttgcataataagtatgtttaaaagacgttttattcaaagtctcgtctctccagttcacatcaggataaagatctggatccaattgatgctttatcgcatataaagcaatatcatcatataatggaagatctccgcgcacaatttttgcctcatttgccaactgagcatactcatatgcttgtaaatattcaggcattcgagtcaatttcgatattgtaaaatttgcacgagctgtaacttgaagtttctctgttgtacccctttttgttgtgattaaaaccactccattagcacctcttacaccatatacagccgttgcggatgcatcctttaaaatagaaaaactctcaacatcagcaggatcaaccattgaaagatcaccttccaagccatcaattaaaaccaaagcaccgctattcgccccaaaagtaccaattcctcgcacccaaaactccgaaacattcttacctggttctccgctatattgttgagaaatgataccagcgacacgtcctcccaacatattattaatagatgcagacggtgctttaatttggttcatatctacatttgttattgctcctactaaactcactttcctttgcgaagtacccagccccgttattacaacctcttctagttcttctgtctcaggagataaagtaattattattttttcttgtttagtaatcaatttttcttgagtcttataaccaataaaagaaactacaagtatatccccaattgttgcttttatagagaattcaccatcaatatctgttgagacaccaactcctggtctgtctttcagataaactgcagcacccggtacaggcgttttttgttcatcatatacgcaaccttttagatctatgacctcttgtgcgaacaattccatactacttatcaataaagataatagcactaatgcatatttcactttcatctttatattcttattcttttgtttataccataattattgaagtgtaagtttacgtatacagcgattccctaaatctgcaatatacacatctccttctgaattcacagctacccctctaggatcgttcaacaaagccatatctgggctaccatctgcataacctgcctctccaggttgtccaataggagtcgtcactataccatttttatctatcattctaatacagtgattaccactatcagctatatagatgttgccttccatgtctaatgacatttgacgaggagaattaaattctgcatcagttgcaattccatcgttccaacctgattgtccaaaagccccagcaaacaatttgtgttctccagtctctatattgtaagtataaataacatgtttagctgcataagctatatataaaatctccggttgtgttggatgagcaacaataaaactatctgtattaggaaaaaagttgccgatcttttgccctactcttgtttctgggtctacctttattaaatcccctccataagaacgagtataaatcatattatcatatctagaaaaagccaaagaatgtttccaatttatttcaaaatcatccattcctgcctcttgctgttctttggaaggatgaagtaccaaacgactcttagcaatccattgatttacaggattcaattcatagaaagtatatcctccgtctaaaggtatatatacattctgcgtctgagcattgacagttggtacattcaaattgtctgacgctttaaacaaaaaagttactgtaccactctcttcattcaatacagaacaagttcctttaccatcactaccatttcgttccgtaataaagagattattttcatcatcaattgcaagatgttgcacgggaccaaattgtgctgcagccaaggtcccttccacaaataaattggttccaggttgcccagcaatagtagtaacagaatagttctctatatattgaaaattacgtgtaaacctagcctcttgattgccaacttttacagtaactatacaatcgttaccaggaagtttaggaacaagcaaataaataatactatttttcacatttagaattgacgcctctttttggttaaaaaataccttgatttgtgagagatctgttccaaaattagctccctcaataaccattctagtcgccattcccccttgtattgggaaaaaatctgttaaagaaataggaagagaaggatcatattctgaatttcccgcctcattcttagaacaggaaaacatatattattccttatatatactcaaatccttgtttaaaacaaaagaagtatctatatttgcagtgtcatcgctcgaagaacgaaggacttggttgcccgcattaccgtaaatgcggtttttttatgcccttatttttccctgtttatatatttgttttggtaataaggttgattatcgcaatcaacacaaaatcctgtaattaatgcgtaatccggttgtatgtattcaactataacaatatattgtttacctctataccaataatagtcacggagagttccgtcatcttcaatataccgaaaataagtaatacgcttatcttctttattctctaaaataggtcttatccaatgtaccctattagctctttcttcacgaaattctcttatttttctggaagttttatactttccacctttaatagtacgagtaattacgtgaacaaacttctcatagtattgctcaaaatcaacaggaagattgtcttttttgctatttttatacaaatacggtttcacttttaaaggagtaccatcaataattacggtattctcaaaaaaatcccgatgaaaaatggcatgaagttcatccattttttcttgttccgtttctgcaaccccgtctgcaaaatacggttttaaagctcctaattcatctgctactgtcattgcgcttacgaggttggtgatcaaaaatattaaatttgatttctcccggttctgtaccttcatccaaaacataaccagatttcatttcaatatagttgatcagttctttttttgccaagctgccatctttcttcaagtgaagacctctcgctttataagttactgcacctatgaaaaaatctgctaactgtataaattgtgattcatgggaacgtatatgctgaaaagaaagaaaaggcgatttaccatgaaacttattagagaagacctcttggattttattaagttttgcacgtcctttcgtatcttttatatccaaaaatacacggtaattattcattgcagaaggattagtgtatggattgacaagcaagtaataaatcattttatagtaaaaattatcatgctcgccgttgttgaaagacaaattgtctaaacggtctttgtacttaacaagaatacatctgaactccatgtttgagtcaaaaaagtaatctataagttctttatacatatcaatatgggtgttactgattgtattccattttatctcatgtaaaatattatgccctcgcttaatcgcttttatgcattgtttcatttcttcagtctgctcctttggcacctttatataaccaatacacatgacaggaaaatgatcatgttctaaatgacagctttcatctatatagaatgtaaattgttctttattcataaggtcgctatatattattctttccaattataattactgaattctccattttctcacttcgggtaatacttgcttatctatctttacattgtataaagtaagaggatttagtgtattccataatggcaatgctttgtttgtaccgtatatgttctcaaccatcgctccaagtaaagcacgcaccattggaggatatttttttgcaagtataagtagctcatccctatcttttttattcaaattctgaataatagtcattatacacttacatgattggctggtagttgtatccggtatctcttttataaacttaatggcatccaatagctgcaataaaggtatattttcctttgttatgggattagactgaatcacgaaactaatcgtgaacattcctcttaccgttttgtttttacgtacatttgtgccaatttggatgatattcggcacttgtgtagtcaatcctaatcgattaaaagctaagtatccagtcatataaccaataacttctccatccttctcaagaaagtcttttacaacttcttctaacttaggctttagcattccaaaaacactttttttaggtttatagaagcgtccttttgagattttggcaataataccttcagctactaagcgatttaagattttgataactctttcactccgttctggagacaaatttaaatcttgatatgtaaaaacataatcagactcaaaattttcaattctttgtcgaatttcctttatcattaccgtctttcttcaatagttatgtcctgctaataagattattaccacgaggttgtattaatgacatttttaaagtacttgctattctttgtctttcatcatattttacataattattgtacaaatatgatttaacacgtgcttttagtattcttaatgccacaggattattctcaaactctttatataataatcttaactcgggtattgataatttcccatagcacgtcttatagaatgacaagaacgcctcaataaactaaaacaaaacaacttataaaactatagtattatgaaaaacattttattcacactttttgctattctcatcttaactagctgcagcaaagatgaagaagattggactgaacttaacagcaataacattataggttattggtcgacaggaatcgaaggtactcacaaattattaagtttcgatgaggatggtactggctcttttggaatttacagcaatgctactccaatttcctttcaaatgttcgattataaaatcgaggaaggtagaatctatatttatgatgtatatccagatgaaaagactccatattatttagattgtaagatatcaggcacgactcttaaagtcgaaaccggaagtgaagctggaacctataagaagcaaaaataaaagaatttaggagcccaattaattgattatataacacaaaaaacaatatgatgaaaaagtttttttatttaactgcaatactaaccatagttttggtttcatgtaattcagaaaagaagtataaagaaaaactctctaatgctgcttccatgattgagaaagaagctaatttaagtgaagctatagttcttacctattgtgatacttggagaaaagtaatttatgatcatgaatacaatggggagtattgcaccgatttcaatgaagccttagctaagcttaatgagttcataatcacaacagatacgtataaaaggttaaaacaaaagagagattcaatcgagactataatgccactactaaatgattatccttcaaattgcaaggatgcttataatgagttagtatcaatatatgcggatgcagatgaattattcagatttgcagatgatcctagagggtctttatctacatactcaacaaaaacgacagacctttttcaaaagatagaaaagtccatgaaagaatttaaagttaagcatatacaaaacaaataaataaggagtctagttaattgattgtgctactaaatacgaaatacagaaatctaaaataaacttttatggtaaagataaatataactgcggaaacaaatggatttgttttgttagaacatggagaagtttttataaagaacaacaatgatgtttctttgaaattaatccccaatgagcaagaagttccccttattattaatattgaatttgctaacaaaggaggacgtatagcttctgttgatagaaatatagtgaatgataaactggttttcacttgtaataattttcaaagtgagccaggcaattggggtggaataattgaaccaatgctgattgcagaaatggatgattgcaatctctatctaagctttttagtttggaacattgatactacaaactataatcgtcttttgaattattcattttggctaaaaaagaaataaaatggacagtaagttaaaagttacctcccaagacgatataatctcaacgagcgatgaaaatctagtaaagacaaaaaactcagaaaccccaataaagctaaaaagcccagaaacctcaataaccaatattattggcagtggtgaagatgctaggaattctataatttacctagttctaaagtgggctttcatagcagcagcagtaattagcactttagtaattataaacaattggctttttagagattgtgagaataaagtacctgatataacaagtgaccttaaagtaatatgggagatagttactcctattataacattggctttgggatatgcatttggcaaatccgagaaataaataaaattgattgtgtaactaaaacatacgacattatgaaagattatattgtaaaatttgaattgaatgatactacttacgaattacctttctctgcagatgtaaatagtagtacagtattaaaacaatgcgccgagcaatgggttgaagactatgtaaaccaaacaattaaatcaggaatggtacaatggcggattttaagcgtgagagaagatgaaaaataaaatatccatttggctatcatcaattgccttatttttcgctttactggctgcaggatttacattttttagaaccactccgatggaagctgattggctaggcatattagtcggtatccttgcattgtctactactatattgcttggatggcaaatcattagttatataggatttaaagatgaagttaaaaaggagatggaaaagactaaagcagaactcaaagaaacaacggataacatagataatatgattcaacaaaagataaatgaaactcaaaatattatctacaaaaagaatgaattatatatacaaggaagcatagcttacttagaagcttatgctaaaattcttaaagacgacgcaacgtctgacaattacgaatcaattgatgctatttacaatctgaataaattacaacttcttaataaagaaagtgaatggacatctttaaagaaacaattgtcaagcctcttgtttaataaagaatcttatttatataaagaaaatcggctgacattaagtagactaaaaggaggaattccccaattgttacttatggaatgtcttaatttccaagatataaaatccaccggacactatataatgctgaaatgatagaaaaaaatgttgtaatcctcagaatagaaactggcaatccatccggtgttgtacgctatattcaaatgttaacagaaggtatgaaacatatgaacggcattaaagttcatattatttgtttaaataccagtctgatctttcccaaatttgaagtgacagaggataggataattgctaatatcccatatccttctaaatccaagcctctgagaaatgaaatatattggcttactaagtattttaacgtcgtatccgacttaatatctccctattttaaaaacaggaaacaattaatttggcatgtgcaagaattattactagtaaaattagcggatattttaaagttatctttaggcggacatattttaacccatttacatatcattccttggaaactaagtcttgaatataatgaaagtctgtttaagaaacagtactctcaatggttgaataacacattcaatttaataaatgaaaatcaactagaaaagattgcatatcctttatctgatagaattatatgtgtttcttattccgcaatgaaacacattatttcagcatatggtatccatccagacaaaatatctgttatatataatggtatggatgatacgggaatcaccttgcaggaaagaaaatctagaacaccagagatccttttcgtaggcagaatcagtcgtgaaaaaggagtgatttgtttacttaatgcattaaataaagtagccagtagagggtatttttgcaaactgaaattagttgggcaatgtaccggatatatgtcatctcatatccgcaaagcatacaaacaactaaagattgacatattagggactgtttcttttaatgagctgaaagaactatatacaacaaatactataggagtcattccttctttacatgaacaatgtagctatgtggctattgaaatgtccatgtttggtatgccaatgatcgtatcagatgtagatgcactttccgaaatgttcgaagatgaagtaaacgctttgagaatccctttagtgtttgatgaagattttggtttagagctagatgaagagaaattagcagacgccatcatccgcttgatagatgatgaagccttaaggctaaaactgagcacaaatgcaatcaagaactaccaagaaagattcactctggaaaagatgatagagaatacgattaatgtatatgaacaattaatagaacaagacaatgcctgaaataacagttctaatgcccgtcagaaatggtgagagatatataaaagaatctattgatagtgttttgaatcaaacactgaccgactttgagtttcttattatagatgatggttcaacagaccggacagtagaaatcattcaaggatatacagacaaaagaatacgtttagtcagaaaggagcatcaatttattcaaaacttaaatgaaggattagagttggcttccggctcttatattgcacgcatggatgccgatgatataatgcatacagaacgattaagaattcaattaaaacgtatgaaaaaaaatccggatattacagtttgtggaacatgggctaagattttcagcgataagggcaacgaaagaaatgtttcccaccttggatatggaatcatacacgaacctgtgttggaattactaaaatacaacatgctacttcatcctagtgtgatgattaaaaaagagtttctgcttaatcaccatattgaatatcaaaattacccctgtgtggaagattataaattgtggtttgatatagcgaaagctggaggaatattatttgtagaaccacaagaactattaatgtttagaagaagtgatacgcaggtcaccgtaacgaagaaaaaggaaatgtctttaggttctatccgtttgagaaaggaaattcttctctatcttctctctatatataataataaaacattaaatagcctattatccgactttgaaaatttagaaaagaataaatggatgtctaatgaagacatttttcgtttttttgtgaatctatttaatagaatacaacgcgatacaatggtttaatctttcaattgaaaattaataaattattttagatagaattagaacaaccatgaatatcgcttttttatcttcatcaaaccctaatgatcaaaataactggtcaggtactggactagagaggacggatctaactatccgataaataaaacattctcatgttatcttcaaataagcttttaatcttttgaaaaaacagatcatgaaaaaactagtatattatatattgttatccataagtgcgttatctttttcggcatgtaccgattatattaatgtggataaatatttctacgatcaggtatcattggattcagccttttccaaacgtatttatgttgacggatggttatccagtgcttatagtgtaatgaataagctaggtgaatacaaggaaccgtttcgctgggcaagtgatgatctttaccatcctgatatgaaagaatatgtggaaggaagttatagtgctgataaaccaaagggtgatgaaaatgctggtgagtctcgtttatggaaatattatgaaggtatccgtaaggcatctactttcttggataatgtagaccgttgtccggaactaactatggatgaaatagctgatatgaaaggacaagcccgctttttacgtgcttattgttattgggctttgatacgtgtttttggaccagtacctcttattccgcttgagggactagatgctgacctttcgtatgaagaattgtctttgccacgtactcattttgatgagatagttagttttattgatacggaacttgccgagacagcccgcttgttacccatgagaagaactgtcaacaatttggggcgtcctacacgaggtgcggctttaggacttcgtgcacgtgtattactttatgctgcaagtcctttatataatggaaatctcgatttcttcaacgtagtagataataaaggaaaccagttgatttctcaaacgtatgatgaatctaaatgggcaaaagcagcagctgctgccaaagatgtaatagaactggctaaaacctcaggtttgtacgagctttacaccatagctcctaaaattgggacattggatatgtatcgtccgccggtgcatcccgaatattctacaaaagattatcctgatggttgggcgaatattgatccgttactttcgtataagtcaaattttgatggttcagttcaaggttccaagaatccggaattgatttttacaagaaccagtgatggaacggggactattaatgattggatgtatcaagctttacccagaacaataagtggaaataaccgtttatgtgtcacacaaaagcaagttaatgcatacgcaatgaatgatggacgcacgatttcggaagctgcaaacacgggtgattatgtgacgacaggttttacaactgaagcatattcggaaaataatccatttctaccggctaaagttagtcttatgtacaataaacgtgaacctcgtttttatgcatctatcgcatataatggttcggtatgggaagcagccagtgcttcggaacctcgatatcgtaatcaacagatcttttattatcgtggaactgaagatggtaaacaaggttttaaagaagaatgtcctcttacagggatgactttgaagaagttttataattcggaagactccagaacagatggtggttatgttatagaaaaaaccgaaatgactattcgttatgctgaaatattgctgatttatgcggaggcattaaatgaattatcggagggggaagtttatcatttaaagacctactctaatgaagatgtagaaataaagcgtgatgaggatgagatgcgttatgctatcaagcgtattcgtatgcgtgccggagttcccgattatacgaatgagacttataaaaatcaagcagattttcgtgtaaaactgaaaagagaacggcaagtggaattgttaggagaaaacagtatgcgttattttgatctccgccgatggaaggatgctttgacagaagaaaatcaattattgcagggttgtaatattaatattagtgatgatgatacttatattgcagacttttacaaggaaactccagtctcttcagtacataaagtctttgaacagcgtatgtatttattcccattcccgacatacgaattaaagcgcaatgtaaatttgacacaaaacccgggttggtaattaaaacagtatcatgttatgaaaaaagtaatgattaaaaatataataaacagccttttactcgttgtcgttttgggagtatcttcttgcaatgatcaattggctgatgaattgtttgaaaaaagaacatatttaatagaaaatggctggaaagattatcaactcgaagtagatgatgacaataccgctatattaccggtttactttggtataaacggcacatctttgaatgataaggatataactttgactttagatgtagatcctgatacacttgaaagatataattgggagaaatataaaaatcagaaagaactttatttaaaactattaatacaagtctcttcgaaaggaacgataatcaagaatggtaatataaaccataggaaagagaagctacccataaaaatataaataaaaggaatacagtatattaataagcctacaattttattcccgatagtatgaattgcaccaagttgataaaacttgctgtaaatacgctataatttgttgggtgtattgaggttgttctcttactgatattgtattcataatgttgtctattatatgttcctttttctatttgcagcaattataactaatgcttgcggcaaaaacagccaaaaaccggaaatcggctctatgatacatccaaccacagcgaacgccaaaatacaataccccaaaatcagaggtgcgggtttctgctcttttttgatatagtattggagtgttagcccccaaagaataagtataatcccacatactaaaaaccaaagggcgaaagcacggctgtaactatcatctgtggagtttattaatccatcttttatcatgtccgtaaagtcttctttcccaagtaatagtgcatatactgtgtggattgctcctgttataacaagaaatgtcccactgtatttccaaagtttcatattttcattcattgtcatagataatattttataaatgtacttttatagtctttattactttctctttttgttatagttctgatggagttgtgtttgccaaatttttagcttcttttacaaaatgggaaaagtcggtatatcccaattcgtcgtataaatcataactaccatttgcacgatagttcttcaatgcagttttaaagcgtaaagctttaaagcattgtttgggtgatatacctaatacttctttgaaatatctattgagtgtaggatttgacaccccaacttccttacttactgtgttcaatttgtaattacggttattattgatatggtaaattgcttttattacagtgttgagtttgaaatcagaactaaagattttcatattacttaaaagccaattctctacaaactgaactcgctcggcaaaagagctttttaattttagttcgtctattactttttgatttagatacttttgcagagacaaatgattatccaccaaagttgaaatatctttagacaaacaggagtacaaaactcccggcttgaattttattgaaaattcatgggttccgggagcgtgtattacagtgatcgcttctgttaagctaccagatatcttatcacccgatgtatcaattataccatgttcacgatgtactttgaatgtctgactactatcggagatataaattgaaactaagatattagcattgggcaaagccacaagtgaaaatggagttatagaattgttaggagtatatatttcaaaataatactcaacaatatcctttaattcaaaacaaggatatttaatctctacctgttcttcatcttcaaatatgactttactctttaccatgtttatttagttaggtgatataatacctgaataccaagcccgaatgtcatcattcgctcttttttgttggttaatagctgttgtgtccaatcaagcaatccaccgtcagcaatttcaatagtattgccgccgatcactatttgctgctttattctgaaaccatggtaatagttattatcatgttccggtgctataaccaagacctcaagattactattctttttccggacatacgatattgattccattataagcgggctttgactgtcataacctttgcatggaataatctcataatatattttctccacaccgtaacttttacatatctcatacgatgtagttaaatgttttaataattcttctttctcaaaattaaagctaccagtatctctaccacatgaaataagggcgagaacagtaaaatgaggagtgaaattaggattattaaatacctgtgtccttattacccgtgaaatgttgctgtaattataggttttgttatctaattctccttttttctttaacgatgcgtaatgtaatgctattgtattcgtcgggtctgcctgtacttctgtgtttcttaaagaagtaaggacttttttctgatctactgttgctataacactatttgtcccaaactgagcgaccggggaaagttctatgggttcaaatcctctacctgctattaatttatagcaccgtaattctttttctttatattctaaaacatcttctaataaggcgggcttaacaagcttgttaccctcatatttacttagtaaagacgagggagtttcctgctgaacacgcttgttaaaaatgtccagtaaaacagtgttcagttccgacccgcttaattcatcggacaacactttagctatatcctgcaaatctaacttactaataaggtgatcgcctatatcttttttcattttttcctaatactatataaatgttcatcaactatttgtccctcttttataactgaggacttaataatggcttccttttcaaaacaattagggtactatgatgtgcacttattaattgattatgaggataatctaaaagcaattcacctattgggaattgaacctcacatctctatgattgcaaaggagatacagagtacgaatgtattttgtggcattcccgttattgttagtgccttgaataatcaatattcgcctgcatccattactatgatttgtatataaatttatacggtatgctcgtatgaaaaagatattgttaaagtgcactatattaatcgttgtactttgttcttgccaatccagacagcaagtaacagcacctatttccaccatagacagtacattacaaactaatgttactgccatattggaaagcaagttgtcagagataaatgcccaatctgggcaggttatagtaatggaagttcaatcagggcaaataaaagctctggttggacttactaggaaagacagtacgaactaccaatcatgtgagaacttctctgtatggcagtctactggtctgatgcacccaatatcgctattggcagctttagaaactggtaaggtgaagttgagtgataaggttgatactggaaatggtatctaccaaattcatggcagagagcttaaagaccataattggcatagagggggatatggtgagcttacagtacaggaaggattggcagctagttccaatattgctatttataagactatggagaaagcatttgctaataatccccaagcatactttgatttattagctaatatgagctatggtaaaccggatagtatcaatggaatagccaatctaaagcctgcacactttgtaactcctaaagataacaactggactaagacagcctttgtatggtctagtatcggttacaatcaacatgtatcgccaattcaaatactaaccttctataatgctatcgccaataatgggaagatgatacagcctcaactatataaggatagtgtagtagttattaatccccaaatagctagtagggctagtattgatagtttgaagaaagctctagtatttaatattactgacggattaggtcaacctgccaagtctgataaggtagtagttgcaggtatacagggaactagttcgttatctactaatgaggatagtactaaggatatgtatgcggtagagttctgtggttacttccctactgataatcctaagtatagtatcattgtatctattaataaggctggattacctgcaagtggtggactaatgacaggtgatgtatttaagaagattattgataacattatatcttataaagaataatctggaataagaaacatccattaaaggttactaattcattggttactaaagaagaaagtactcatattctatcgcagaactaaatgtaatcagggaagtaactatactgatgaagaatgatagataatataacggattagataagtaacgaagagtatataaagcatttatgaagtacattgaaatccacagattaattcatatctttattccaacttaattttagtaacaatgaatactgatatactgataggtgcaatagcaggagatataataggttcttactatgaatttgtcccaataaagtctattgacttcccgttattcaatggttcttcatcacactttactgatgataccataatgactatcgccaatgctgattggctattaacaggcgatagcttattaggcataatgcaggactatggtaatcgctatcacagtagttatggaagtatgttctatgaatggttgagagctgataatcctcaaccatataacagttggggaaatggttcagccatgcgagtaagccctatagattgggcttttaatactttagaggaaacattagaagctgccaaacaaagtgcagaagtcacacataatcatccagaaggaataaaaggagcacaggctacagcagcttgtatatacttggctcgtactggtaaatccaagcaggagattaaagagtatgttgaaactacatttggatataatctaaatagaacttgtgatgatataagacctacataccacttcaatgaaagctgtcaaggtacaataccagaatctattatcgctttcttggagagtacggattatgaaagcgctatccgtcttactatatctttaggtggcgatgctgatacaatgggggctattacaggtggaatagcagaagcatattataaagagattcctcaatatatcatagatgaagttcttaaaagactgtctgaagaatttattgatataatgcaaaggttctatagaatgtttattagcagctaataagatgcggaatgtaagaattgtattattggtactagttgtagcagaatgttgcatacaagcagtattatcttattggtggtatgaatataaatgtggagcatattataatctagtaattaaaggtggtacattacattatatactatgccaagtagaagatgttctattagttacgagtataactaacagcttccaataagagagaaccaaataatatattagcatcaactatatctcttactgatttttcatctgaatgaaaattgaaattagtagctaaatgtattactacctcaggagcaaaatcaataatctgttggcgaaatgtcctttcacaagaaatataagttaaaggaatactttcaaacatagaaatagctttctgaggatctctcacggcaattgccaattctacaaatccatgactaaacaaataaggaacaagatttcttccaacaaatccggtagctccagtaatcagaattttcatatcttaaaaatatagggtatttcagacaactcttttctatcagattctgtcggatcatgcggttctggtatcacattcataagcatagatttaccttttgcaattccacaaaaagccaaccataaacccggagcaatagtcaagcgataatatctactatccggagaaagagtaacttcttcgaatttaccataagtcatacttccttctctatcatcataaattataaacttaaccattccgactggcaccaccaaattcaaggtcattctattatgtcttttccatcccttcacttctccatactcgatccaagagaagtaggtctcaccaaaccctacatatcctaaatctgtagattttagtgcatgatacacatccccctttgaaacacgaatctgttttaaaggatatatactaactcccaacatcattttgtccattgaagtcgctgtttctgagcctcccctagatattccttaatctgtgcaacagtaagttggtacatatctatattctgttgaagataaaaagttttataccaatctgcaatgaaacgcacacattgttcataatgaagagtagaatgccaatttaaataagctaatgccttatcgcaattgagcttcaataaactagcttctttaaaaggaatattatctgtcaattttgctacatgatctttatctaatccccaaagttctgataaatcctgcaccaactcaaatacagttttagtttgctctgcacgtggaccaaaattaaaaggctctccattctttactttatcttcaaatagatactgtcctaaaaccaaatatccactcaacggctcgagtacatgctgccatgggcgagtagctttaggacaacgcacctcaacaatcctattctgagaaaaagcattaatacaatctactataattctatctttagcccaatctcccccacctataacattccctgcacgtgctactcccaactttatattcggcataacctgaataaaagatttccagtaacattttataactagttctgccgcacctttagaacccgaatatacatcttttcctcccatagcatctgtttctcgatatccccatatccattccacattatcatacgctttatcacttgttatcaatacacacgtacaatgccatgttatattacaaatagcttccaatacggatgccgtcccaacaacatttgtagttattgtatcaaaaggaaatttataagaagtagaaacaatagcttgcgcagctaaatggaaaataaagtcgggctttactttttgcacaaactcattcagttttgctttatcacgaatatcaccaaaacagtgatgaagtttgtctttgagtttaagtgtttcaaacattgagggatcagtaggaatatcacttgaatatccatatacatcagcccccatcatcaacaaccaagtcgataaccatgaacctttaaaacctgtatttccagttactaatactttcttgccttgatatacgttattaaatgccatatatatatattttatttccaaatttgccaaggagcatttctcttatcccacattgcatttagttctgcattatcacgaagtgtatccatcggcttccaaaagcctgtgtgtttatacacatgtacttgtttctgtgctactaaacgttgcattggttctttttcaaacatttccatgtctcccttcaacatattaaaaatgaaaggctcacaaatgaaaaaacctgcattaatccaagtaccactttcttgaggcttctcgacaaaagaatctaaagttccatcatccagtatatccaacactcccaatcgtccaccaggttgataagctgtcatagaaagagctttacctgattttttatgttgatcaatcgtatctgcaatattaatatctgcaactccatcaccataagtaaggcaaaaagcctcattaccaatgtatttctgtacacgtttaatgcgaccacctgtcattgtattcaaaccagtatccaccatcgttactttccaatgttcagaatgattatcatgaatttgtatactatttgttgacaaatccacagttagatccgagttatgtcgaaaataatttgagaaatactcttttataacatattgtttataaccacagcaaataataaaatcatttattccataatagacattattctttataattatttcatgtattattatggatgtaaatcttcatacaaagaatcttggtgagttcaaattatatccattaacttctttgttttgagatagagtttttatagataaattttataatgaaagtattagttacaggggctgctggatttattggtagttttacttcaaaaaagctgttagagcaaggacatgaagttgtgggtttggataatctgaatgattattatgatactagtttgaaatatggacgtttggcgaatttagggattaataaagatgaaataggttggtataaatatactcgaagttcttattatacagccttcaactttattcgtatgaatcttgaagataggcaagcagtacaaatgttgtttgcaaatggcgattttgattgtgtatgtaatttggctgctcaagcaggggtgcgctattctattgagaatccttatgcatatattgaaagtaacatagatggctttttgaatatattggaagggtgccgaaattcaaaggttagccatcttatttatgccagctcaagtagtgtttatggtttaaatggtaatgtacctttttcagagaaagatagtattgctcatcctgttagtttgtacgctgcttcaaagaaagctgatgaattaatggctcatgcatatagccatttatataatattccgactactggattgcgcttctttaccgtttatggtccatggggacggccagatatgtctccattcttatttgctgatgcaattcttcatcatcgggctattaaagtttttaataacggaaatatgtttcgtgactttacgtatattgatgatataatcgaaggaataatcagggttatgcaacatgttccaataggtaataagaattggaagcctgaaaacccttcccctgattcttcttcagcaccttataaaatatataatattggaaactctcgtcctgtgaaactaatggattttatccaagctattgaaaatgcgataggtagagaggcggaaaaaatatatcttccgatgcagcctggagatgtatatcaaacgtatgccgatataactagtcttgagcatgatacaggatttaagccagatacatctttgcttgagggagtgaggaaaacaatagattggtattgtgatttttataaattagatagtaaatagttgtattatgaatattgcagtagtaggaaccggatatgttggtttagtctcaggagcatgtttctcggaaataggagtaaatgttacatgcatagatgttaatgagaagaaaatacaggctttaaaagatggtaaaattcctatttatgagccaggcttggatgaaatagtccgtcgtaattatcatgaaggacgattacattttgatacagatattacaacatgcttaaatgaagtagaaattgttttctgtgcagtaggaactcctccagatgaggatggtagcgcagatcttaagtatgtgttagaggtcgctcgtactgttgggagtaacatgaataaaaaattgcttttcgtaacaaaatctacggtgccagtaggaacagcgaagaaagtaaaggcagctattcaagacgaattaaagaaacgggacctagatatttcttttgatgttgcaagtaatcctgaatttttgaaagagggtgcagctattaaagattttatgagtccagatcgtgttgtcgtaggtatagaatcagaggaagctaagagattgatgacactcttatatcgaccattgatgcttaataattgccgtattctttttactgatataccaagtgctgaaatgataaagtatgctgcaaattctatgcttgcaactcgtatcagttttatgaatgacatcgctaatctttgtgcattagtaggggctgatgtgaatatggtccgtaaaggtattggggcggatagtcgaatcggcagtaaatttctttatccaggctgtggttatggtggatcatgttttcctaaagacgtgaaagcgttaataaaaacggctgaaatgaacggctatgagatgagagtgcttaaagctgtggaagaggtaaatgaacagcaaaaacaaattatattcaagaaactttcagaatattatgaaacaaaattgattggaaaaaatgttggaatttggggattagctttcaaacctgaaactgatgatatgcgtgaagcaccttcattggttgtaatccgaaagttgttagaagctggatgcagagttcgagtgtatgatcctattgctatggacgagtgttatcgtcaacttggtgatgctgtaatatacgctacagatatgtatgatgcgactttaaatactgatgctttattattattaacagaatggaagcaatttcgactaccaagttgggaggtgataaagaaaataatgaagtgtccattgattattgatggtcgtaatatttatgaggcacaagatatggtaaatcttggttttgactatgtatgtattggaagatagtatatatatatctattgctgttctgtatatataccagcctgagcattgtatatataggtataatgcccaaatgtacaaattctagataaaaacaaaaataaaaaggctttttattttcagtttttgtgcaaatattcgtagtattgcgtaaaatatctaaagaatagaaagtaatgaagcgagatattcagcgtatcatgctggctacagcggtgccgttgttcctaatttttatcctatttctgctaaagatcgttgaagtcggcatggactgggacttctctcacatgggaatataccctctggaaaagcgaggaataacgggtattctgactcatccgctgatacacagcgggttcagccatttgctggccaatacgttgccgctattttttttatcatggtgcttgttctatttctacagggggatagccggacgtatttttatgatcatctggatcggagccggactgctgaccttcattatcggcaaaccgggatggcacatcggtgccagcggactgatttacggacttgccttctttctttttttcagtggtatcctgcggaaatatgttcctctgattgccatctcactgcttgtcacctttttgtatggaggaatcatctggcatatgttcccctacttctctcccgccaacatgtcatgggaaggacatctcagcggaggaatcatgggaacactctgtgcattcggtttcttgaatcacgggcctcaacgaccagaaccttttgcggacgaaacggatgaagaagaagaggaatctccggaagaagatatcaacaatacaaccgactctacggatattacctcataaatcccggttacgacttatgcaatgcctcaatcagcaaggtgatattagcagtaaacaaccttactgagatagcgagcaggatgataccgaaaaacttacggatgatatagatcccccctttcccgaggaaacgttccacacgtccggtcatgcttactacaaagtagacccatagcatattcagtatcaaggcaataataatgttaacactggcatattcggcacgaagcgaaagaagcgtagtaaaagctccggcccctgccagcagcgggaagacaagcggaacgagtgtcgcttcctttatcggcccctgatttttgaagatttctatatccagaatcatttccagagacatgaggaaaataacgaatgcgcccgccacggcgaatgattcgatatctacatgaaaaagtttcagcatcatatcacccgcgtagaagaagcctatcagtaaggcaaaggagatgacagtagcctttgttgcattcacatctttccccttttccttcaggttaataataataggtatagaaccgataatatctattactgcaaaaagtacgataaacgcactgatcatttgctgccaattaaaacccgtgaacataattcctccttttttttgcaaatatactctatttttatgcattcaaacaataaaaaaaacaaaaagaaaggggatatgtggatagcagtgttgtattatgagtaaatttgtacgattaataagagattacaacgtatggaaacaatgttcgatactttgctccaattacctttatttcaggggctttgtcatgaagatttcactagtattctggataaagtcaagctgcactttatcaaacataaagctggggaaaccatcataaagagtggtaatccctgtacccagctttgttttctgttgaaaggtgagatttctattgtcaccaatgcaaaagaaaacatttatacggtcatcgaacaaatcgaagctccctatctgatagaacctcagtctttattcggtatgaataccaactatgcttcttcttatgtggcacatacggaagtgcatactgtttgtatcagcaaagcattcgtactcagtgatctgttcagatatgatattttccgcctcaactatatgaatatcgtcagcaaccgggcgcaaaatctctattcccgtttatgggatgaacccacgctggatttaaaaagcaaaattatccgtttctttctgtcacattgcgaaaaaccgcaaggggaaaagactttcaaagtaaagatggacgatttggcgcgttgtttggatgatactcgattaaatatttctaaaacactgaatgaactacaggataatggtttaatcgagttgcacagaaaagagattctgattccggatgctcaaaaactactttaagagattgacagtttgggtagaacaatctaatatatataaggtagaaaaaagtcaaaagaacagtcttctaattattttcaaaggaaaaatcgacctaattatttaaattaattgcattacttttcatcctggagagcaatagagaccttatgccaaattgaataattttgaagaagtcgtaataggacttggtatttttataccccaaagtatattttctactgtttccataggctattcaaaggttattaagtgcatgtactattctaagacggtgtaaagtttgctgggaggtggagatataggagctactaaattatggtgggtacgttcaaacaggcccaaacaacctaatcagtaataatgatattcatttttaagaaaagaaaattatgaaattattaaagtatttgtgtataggtatatctgccttaagtatactaagctgttctgactggacatctgaagaaagagaggtttttgagaatcaagaaggaatgcaccgtctgattcccctaatagaagcccaaaccgaagaagatcttacaccgaccatgcgtgaatatttcgctcaaataagagaatatagaaaaactcctcatgtgaaaggctttggttggtttggtaactggactggaaaaggaaacaacgctcaaaattatttgaagatgttacccgatagtgtagattttgtatctctctggggaacaagaggttacctttctgatgaacagaaagcagatttgaaattcttccaggaagtgaaaggaggaaaggcattattatgttggattattcaagatttgggagatcagctgactcctaaaggattgaatgcaacgcaatattgggtagaagaaaagggacaaggaaacttcattgaaggagtaaaagcatatgcaaatgctatttgtgatagtattgaaaagtacaatcttgatggttttgatattgactacgaacctggatatggacattccggaactttagcaaactaccagacaatcagtcctagcggtaataataagatgcaggttttcattgaaactttaagtgcccgcctacgtcctgctggaagaatgttagttatggatggtcagccggatctcttatctacagaaacttcaaaattggttgatcattacatctatcaggcatactgggaatcaagtactagttctgtaatttataaaataaataaaccgaatctggacgactgggagcgtaaaacaattattaccgttgaatttgaacaagggtggaaaactggtggcataacttattatacaagtgtgcgtcctgaattgaacagtatggaagggaatcagattcttgactatgcaacactcgatttgcccagtggtaagagaataggtggtataggtacttatcatatggagtatgactacccgaatgaccctccttacaaatggttgagaaaagccttgtattttggtaatcaggtatatcctggtaagttcgattaatattaaagaatgactattatgaaaaagaatatttatttagctgttctgttattcttaacaggttgtcaaaatgagttatataaaaatcctttggatgattttcaaagtgagcaaggagtatatatagctaataacggcgtattacaaagctttgtggaagaaggcaaagatgtggaaattaaagggctgcaagtagctttagctgttcaagatactaaagaaataaaagttacattggaggctggtaatcaagctcagttagatgcttataatgctaaaaatggaactaactatatagtacttcctaaagagatgtatgagatctcacagaaaataacatttatgcctctttatgcaatgatggatgttcctatttctttgaagaatgtaaaattctcactagaaggtaactatgctttgcctatacgtattacaggaggtgacgtgaatattatcagagggcaagaagagactttacttgtacttgagcaaagagtgaatacaaaagcgctccggataagtacaagtggaagtggttcggggagcgaggatgataaaatgttccctaacgatttcaaagttgatcaatggacaatggaagttatggtcaatagggctagttacaaaagtaacaatcgttctatttgtggaactaaattggttgccaatgctggtcctatggatgagatttatactcgtttcggtgatgtaactattaaccctaatcaattacaaattaagacgggaagctctcagattgatgttcccgctgacaaattctctgcacagcctgacacttggtatatgttagctttcgtatatgatggtcaaaagaattatgtatacgtgaacggagtgctggttgctgaccgggaaatcagaacaggtccttatggattgattggcttttggattggtggttcaaacgagctgattcgtgaggttcgtttttggaaaacggccagaacttcgcaagagatagcttcgaatatatggaagatggtaaatcctgacgatgacaatttactgctttattatccattgaatgggaagaagagggatagtgctaccggagaaattacagaggatgagactctgctttgggactggagtaagaatggtaagaatttacccaagccatcaagttattcttttgatgataacaaagggaacgggtttatattcccaccgcaagaatagcaacaaactacaataaattgtacatatagaaaaggctgcctttggaatgaggcagcctttgtttttactatacattgtaaataataacaacataaataaagagacagaactatccactcaacaattcatgttgtatattgaaaaataaccactatctttatacagaatattattcactcaaacaaaattagttaaccctaaaatctagaaagcgcgagaaactattgaaagacacagaaaaacacagcttcttctatattgccgtatttggttatataaccacagtattacctcatcagaatgaaaaactgaaagcgtatcttttctaagcttctaaactttcctgattcaataaaattgaatgatggaaaataggaaatgtgttatattgtcaataggagtcacattggctatctgtggaatgttatgcagtagcttttgggggcgctatagtatgtttgataactattttctacttttccctgtctctttggggatatgtttggtcactataacggccattctttcatttcttacaaagaagaaaatttttcaattatctgtagcggatgtactaatatctattttagtggtttactatatcgttcgatatgattatgaacttcaattagccaattggaaaataatgtatgctattttattattgatattatggtatgcactaaggattctattgatgaatgctacaatatctcgacccattctctttggtggcattgttgctattggttgtatgttgtctatatggggattattgcagctttatggattgcaaccatctaatcacagattatttgccatcactggacctttttataatcctggaccttattccggttatttagctatgatttttcctattaatttaggttgtctgctccagtctatggggaagacacgatatttgtggctagtagctttcgctttgatgctatgcattttgcctgccgggatgagtcgttcggcatggttagctttgtcctttagtagtctgtgggtattggttatacattttaagtggatcactaaggcaaagtcttatttgcagacgcatttctatactgctactttgctttatataactgtagctattattattgtgtgtgcatcagtgttgctttatcagatgaaagctgattcggctaatggccgattatttatatggaagacgacgtgtaaagtaattgcgaataaaccgttgttagggtatggcccgggaactttttctcatgtatatggtgagatgcaatcaacttattttgcatcggaaaaatatacggaacaagaagaaagagtagcaggagcacctgaatatgcttttaatgaattgttacaattatgcgtagagggtggcattattttgctgatgctgtttttgatgctgatagtttgggtagtcggtaaaggaatatctaataaagattatatcgcttgttccggccttatctctttgctacttttttcattatcctcctatccttttcaagttcttccatttctaatgatgggagtattattacttgtagtttgtgtcactaatcctaaagggataatagagaagaatgcctgtattccacgaatatgtactctattgttactaatatctatgttggcaggaaatattttgtgtctttacaaactatgcaatgtaaatgaactttcccaacgtttatattatataaaggtattacaggatcaatctttacaaaaagaggcttcgacaggatatggacggttatatgacttctttaaacataactttaattacctgatgaaatatgcaggaaatttatttgctcaaaaaaggtatgatgaagcgatagtcattttagaacgtgcaaaattagtaagttgccatcctagtatttatactctacaaggacaatgctatcaggctttaggaaactttgctgatgcggagaaatgctataaagcggctgctttattattgccaattcgtatttatccttattatttgttggcaaaactttatgctgaaccagacttttaccatgaaacgaaaatgaaacagatgataaatattgtattgactaaggaacctaaggtatactctaaagcaatacatgaaatgcgcatggaaatgaatattttattaaataatcgaattactaactaattaaaaactaatcaaaatgaaaaagaaaatgatttatgttgttgccgctcttgtactgggtgctgtaactgtgtttaatgtgaagacagtgttggaagcaaatcacgtgtatgatttgacgatgacttccattgatgcgctaagtgagaatagtgatggagaaagtggtgaaagcggaggaagtaccggagatggagaaagtgatacaggtgctaatatcactgacgaaagggaatgtcataataagaatggctattggaatatggcattaatatgtacagattcggggattgagaaactaacttgcgaaagaacaggggaacttacgctttggggatttactgtttttaaagtttcttataagaaaggagaaaaatatgaacttgcatgggaacgttgggcatgtacaactagtacaggaaattgctgcttatctgataaacagggacttagggttagataaccgtatatatgtataataaaataagtactatgaaacagaaagtctatatgataatgctttttttaagtagcattattgtagatgccatttatttcattgtaaatatgaaataaaatcggaaaatattagaaataatattatgtaatataatattgttttgattctgtttttattttgcttgtttcagtaatacttccaatggtggtgtatagtccgtaattttcgttagagaaggattgtggctgaagtatgcgttccctgtctctccattgcgttgtttggctacgatgactacccccagtccttcggtcggataaccgctttcccggtcggtagtgagccgtgccagtgcagggcggtagagcagcattactacatccgcgtcttgctcaatggcgccgctttcgcgtagatggaacagttccggccgaccaccgggacggccttccgattcgcggtttagctggcaaagcaatacgacgggaacgttcagttccttggcgagcaatttagccttgcgggtggcttgtgccacttcctgttcacggttgcggttcttctgtccggtgttcatgtcgcaaagttgcaggtagtcgatgatgatcagatcgcatgcactcttgcttttaaggagccgtgcgctggaacgtacatggtccatactgatcgatgtgctgtcgtctacgtgtatcggtagccgtgccagttctgcggcggtggtgtgcgcttccgctacttcgtgcgggttagggatgcctgtgcgccagcggtaagggttgatgtcgctggcggacaacagccagcggtcggcaagtcgttctccttgcatctcaaggctgtagacggcgacggcatgtttctgcatggcagcctgccgcgccagatggagggcgaaggcggtctttccgaccgaggggcgtgcggcgatggcaatgagttctccgttttgcagtccggacgtcatgcggttcaggtccgtcaggccggtggggatgccggtaattccgtttacgcttttggcgatacgctgttcggcttcttccattgtgtcggtcatcagtgcgtccatgtcgcgcatgtggtcgttgtggccgaattcaccttccaggcggtcgagcaggttgtgcgcatctatcagcgtatcggctatgtccattgtttcgtccagggagcaggcgaggagtttgttgagtcctagtatcatttcccgccgcaggtatttctcgtgtacgatctgcatgtgatattcgatgtgtgccgaggtggctactatgctgctcagtcgcgtgataccgaatgctccgccggcttcttcgagcttgccccggtgggcaagctcttcttttacggtgaggatgtcgatcttcattcctgcctggtacatggccagcagggcggcgtagatcacttggtgacgcatgctgtagaacatttccggacgcagcgtgtcggctacgagcggcatggcttcctgttctatcaggcaggcgcccagtatggcttcttctatctccggagcctgcggagaaactctgttgtcagtattcatattcattcagaaaggctttattggataaataactgcaggcatgtaacgtgaatttcatgtttgtctgatgataataatattcttcgatatggtcgatggcgagctgctgttctttttcgctcagctttttccagatacgctgcgccttggcgatgttctctttggggagctgcaggatgttgtggtagtcgtcccagaagaggcggaacttttcgttgctggctttttgtgtgttttcttttttctcgttgaggagtgccgagatgtttgtccagttttcgtagttgaccactcggatatgcagggcggtggtgtcgttgtgagggatgatttcgatgatcccgtttgttttcagttgttgtatgaagcggtaggttctgctcgttggccagtggaaaatggcgctccagctgcggtagctgtgcaggctttcacctcttttgcacacgatggtgcgtctttggtggtcggtgagctttgtttccgagtagttgacttttacaagaagtttcaggaaagcctctatttctccttcatgtgggctgcagtctataagttgctctttcagcagagctttggggataatgatgtagccatatccgatggcttgacaatccattttttgcatatgatattctgttttttaaattttgtccaaaagtaggttgatcgttgccggaatcctaaacggatgtgcgtgtttggacgtgttgggatgtaatattccttgcggggacgtaaatagctgcttttggcatgtgttgttttttgtgcgctacacgttgggggaagattgtgaaacagaggcttcgtttgatgcgaacagagcctctgtttatagtaaacgaagcctctgttcggtcattttggagcctctgtttgagggtggaaaaagggcatttttgtggaacgcacagcggaacactctggagagtgaggtaatcttctgacatctagtgaattatgtctgttgagaaaaatcttttgaaacgcagggcggaaccataataagggataactaataaattatatatttaaaaatatatagttcgattttcgctttttgggcgttcaaactcgtttgttgtccgattcgtttgcgtggttttccgacagtgaaaatttatataagggcaactaaagaatcattttaaaatttgaagaattctataagtaaagaacattttatacttttgcactgttttgaataaaaaattaacaggtttaaagtagaattatggcatctataaagttattgctcaataaacagcgaatgcttaataatggtacatttccattggtttttcagtttatccaccggaggcgaaagttactttattataccaagtatcatatctttcagcaacaactggctgatggagctttggaggttgagtattgtgaagcatcgctttattccatgaaagaaataaaggagataaatcgtgagttgaaacgggactataagcgattccagaatcgtatattggagttggaaaggaacaatgaggagtatttagtagatgatatcgtagagtttaaaaagaagaagagtcatcgttcgtatctacttatgcagtatatagaaacacagatttcttataaaaaaaagatggggaaagacggtattgcagccgcctatcatagcacctatatttctctgaaaaaatatataggtatgaaatctgcgcgtaagtcggatatcaggatggaggaaataaacttcagctttgtggtagggtatgaggactatttgaatgcacaaggactggcgaggaatacgattaattattatctgcgtaatttccgaacgatttataattcctctatccgggatggatttaagcctaaaagcgagaatccttttacttacattcagacaaaaccatgcaagacaataaaacgtgcaattaataaagatgatatgaagaaactttcttcgcttattttacctgttcattctggaatggacattgcgcgggatatgtatttatttagcttctatgcccaaggaatggctttcgttgatattgtatttctaaaaaagaagaatattcgtgatggaatattgagctatcgacgtcataagtcacaacagctgattcatatagttatcactcctcagatgcagggattgattgataaatacgcgaatgacagtgaatatgtgtttccaattattgatacatctttgtcgacatctatctacgatcagtatcgcctggctttaggcagggtgaaccggtatttaaaaaagatcacttttcggttaaatataaatgtccggctgactacctatactgcaaggcatacctgggctacactggcaagagaaagcggggcgcctatttctatcatcagtgcgggattagggcatacttcagaagaaatgacgagagtatatcttaaagaattcgatcaggagacgctggcgcgggtgaatcgtattgtgaccaatctgttataatatgaaacatgaatttgttcttcaaattttgtaaaactcatatttataacttatatttgtaaacggtatctattttgtaatagagagtatatcaatcgcttaataatagcgatgttgcaaaataagactattttttgcgaatagccattatcaaaaagtacattaatactctccttttgtacgatcccgcagttctccttaaagattatcggttttcgcctgataacggtctattaattgctttggagtacagcgaaaatgctgtttgaagtagcggtataactgagcttgcgactcaaagttgcatacctccattagttgcttgacacatatacccggttctataacttttcccaaaatacgtttctttaattgtttcatcatccattgttttgcggtaattccgaattcttctttgaatttaataaagaagctggttcttcctatatttgacagtgtaattagctcatcaagattatttacttttgaatagttctgcatgacaaaatctctaaactctaattgcctgccaatgatagggtggaaaagtgtagcaatttcttttttattatagaatcccctgagtaggaagaaaaattcacgttctattacattatgtaggtatgtacagttcatttcattcctcaaacagtggactacagtttcaaggaatggcattagtggataacgcatggggatagggctgaaatcatagtcaatattttcacaaatggagctcaaaccttgaaataaaagtttgtcacagttgctttgaggtatatcaaatgccatagccagcatttgggatttgtctgttgcggaaatctttatcattgaagatttaggcaacactaccatttcattgctatgaaacgtgcggttacaaaattggttacagtatactgaaaaatctccttctaaaaaaaataaaagataatttttgtgggtatactcttcctctatgcatttctcagtgtcgaatttaatatatttgaatcctgtatcaatatctgtcatgtaatttttgcatgacaaatgttccctggcgtaatgtaatccgttcggtgattgttcccctctcatatctttccctttttgatggcaacaaagcgattatactccattatgcttcataattgattcagtatggtctaatataatcactttattaccaatgtattataatgaataaaattaaagcctgttatgtatatgcagggtatgaaacataatatatagtatatggttgtacataaccctctatcaaatacttgagatagaatattattcgcagataacttttggattagtatttttaatacaattatcatttgttctacaaacaaagtgataaggaacaaaccaccgaatataccaccataaatgaaagcgttgagaaaaaaattatgaggcattttaatgtgagtgttagtataataaaaaataccgcctactggagttgattgaataaaatcccaggcttcagaccaaatatgacttcgagcatcctctttgatactgaaactcgattcactatatctaaatccatcatccaaaatactgtcataaaataatgggctaccaaatacaattattaatattgtagctataaaaaaaaatatccatttgactttgtttttctcttcagaactaccgactaacttaacaatcattaatatcgaaacaaagcctgcagcaaacaaagcagttcgttcttgtacaacgaacactgaaacaaggaaaaacattaacaatattatattccagaactttaaacgagcgctcttattataaaatattaaagcacacgaaactgcaagtacatatccatttaatacggagccaacaatgcccggaaccgcaagccctgctagagtatccatctcacggagttcagctctctctaaaagttcatcagcagctgtaatatttaaagtatcaagtatgatatatgaaagtggccgctgccacatttgaattaaagtaacgacagcatcaacgaaaaaaatagaaagcaaagataacaaaacaaaccttgcccccctatattttgaaattatcattcgagttgactgatatcctacaaatgcaaccaagtaataacttaataaatttctaagagctatatcaaaacctcctgtagagaaacaagcgacaagataaaagaacacaaatccaaaatacagttttgcatatttatcaaaaaaaagataaccctcctttatgcaaacgactatcataacaacagacattatttgtctgggggtaacagggccaatatataaagacccataaagaattgatgatattaaaaatatcaagtataataagtaataaaataatattttcatatattctagcaatctcctgtttattaacaaacagttatatagtgatcttgaatcaacaacttattttttaaggtgagtaagcgacaatatagcgagcccaggtcctttcttaagaattaaagccagaagaaaataaaagaatgacgcaaaagttattgctataaacatttctaacacccaccaaaaaccatcaaaatctggtatatacataaaaacaccaactgtaataaatgaaacaaagagagaaattccaaaagaatagaagatttgtctcaactcaacatgggtaagtttcttaatagtgtaaaacaaataaggaaatacacatatcacagcaagaagaatagaaatgccagcaccaataagaccataccaataagtgagaggataaagaagccctatcatcactaacattttgattgtataaaatctgaattcctgttttgtaaagccataagctctcaataatggattaaatgaaaacaacaaagtttgaaaaacatatgatacaaatattattttaaacggttcaaccatttccacccaagtactgcccaatacaagaagaacaataggctttgcataaagcacaaccacaatacacatcatggaaagaagatacatgacaatattctgaatttgactaaggacatggtcgaccctagatttatcgtctgttatctgagcataaagtggaaaggcgacattatcaatcacacctgtaacgaaagttcttggataacctgcaattgtttgagcacgattatacaatccaagagatgctgtacccaaaacgttaccgactatagcaacatcaatattagtagtaaaccatgacgtgatatttttcaactgcaaccaccccccaaatctatatagctcataaaatttatctttgtcaataacaaacttaactttatatggataaacaaagaatgaatatattagcctaaacaaatattctgatagtagtgcaataattaatccccaataagacttcatgtagtacacgctaactacaacgagaacaaaactaagaatttttggaaaaactttaagatagaagtatttctttaatttgatctccttctgaaaatatgctattgcaggattttgtcctgctgagaatataacacttaacattataaccatagatggaagcactccttcctcattatggtaataataagtgcatattggaaatatcaaaaattccaaaactattgttgctactattgatgctaataaattcgcagaccaagccgtatccaaatagtctttaatatctcctttcttctgaactaaagctgggcctaatcccatagaaaacgcaattgttccaaggccagtaaaaaacacagcaatagcatagacaccaaaatcagttgaagacaatattctactagttattgccaattgtacaatacctaatactgtaaatataacattttcggcagctgtccacattgttccagataaaaaaacgctttttaagcttttccccattttactttgatataagatatgattttacattataggtatataaatctatcattcaacaattctaaatgataggtgagataaggtatctgaaactgccatctacttcaaattaccacaaataaaaaactcctgtaatcacatggactacaggagtttatttatataatgtaactttaattacttagccaaagcctgagctacgtctacagcacaagccactgtacatcctaccatcgggttgttaccaattcccaggaatcccatcatttctacgtgagcaggaactgatgaagaaccagcgaactgagcgtctgagtgcatacgacccattgtatctgtcataccataagaagccggaccagctgccatgttatcggggtgaagagtacggcctgtaccaccaccggaagcaactgagaagtatggcttaccagccaatacacgttctttcttataagtaccggcaaccgggtgttggaaacgagtcgggttagtagagttacctgtgatagatacgtctacgccttctttccacatgatagctacaccttcgcgaacatcgtcagcaccgtagcattttacttttgcacgaggaccgtcagagtaagcgatttcgcgaactactttcagctcaccagtgaaataatcaaactgagtctgaacataagtaaaaccattgatacgagagatgatctgagcagcgtcttttccaagaccgttcaggatgcaacgcaatggctctttacgtactttgtctgcttttgcagcgattttgatagcaccttcagcagcagcgaaagattcgtgacctgcaaggaatgcgaaacatttagtttcttcgcgaagcaacatagcagccaggttaccatgaccgataccaaccttacggtcgtcagctacagaacccgggatacagaatgcctgcaaaccgataccgatagcttcagcagcttcagcagcgtttgtgcagttcttcttaagagcaattgcagtacctaccacataagcccattttgcgttttcaaaacagataggctgagtttcttcacacgttttataaggatcaagtccggcagcttcgcagattgcgttagcttcttcgatgtctttgatgccgttagcgttcaaggcttcaatgatacctttgatacgacggtcttggctttcgaattttacttctctaatcatagtttctttcctccttatattattcgtgacgtggatcaatgtgtttaactgctccctgttctgctgttacacgaccataagtacctgtaactttcttcaatgcttcgttagcatcagttcccttcttgatttcatccatgaatttacccatgtgaacgaattcgtatccacagatttcatcattcttatccaagaagatatttttgatgtaaccttcagccatttcaaggtaacgaggacctttagccagagtaccataaagggtacctacctggctgcgcagacctttacctaagtcttccagacctgcaccgataatcaaaccaccttcagagaaagcagactgagtgcgtccgtaaacgatttgcaggaagagttcgcgcatagctgtgttgattgcgtcgcaaacaaggtcagtgttcagtgcttcgaggattgttttacccggaaggatttcagcagccatagcagctgagtgagtcataccggaacatccgatagtctcaactaaagcttcctggataacgccttctttaacattcagtgtcagtttacaagcaccctgctgaggtgcacaccaaccgataccgtgtgtcaaacctgaaatatcaacgatttctttagattttacccatttgccttcttcgggtatgggagccggtccgtggttaggacccttctttacaacacacatgtgttccacttcgtgtgaataagtcataattagctcttttttttagtgatataattaaaaatacgtagtcacgattctctaaatcgcccacaaaggtagtcgatttatttgtttctgcaaatcgccatatcttacttttttgtgaaaagtgacaaatccgtttacgttttttcttcgtttgctaagtcgggattgcatttgtgaaagattactatgtgtcgaactatctattcgttgctttgttgttatctgaaatataaattttatggaactcaatcaggttgatatacattatttgatagcggcaatctgcgttatttcatctgcattggtattttatactatcggtgtatggggagaaaggctgcaaaagaaactgaagttatggcatattattttctttcttttaggattggtgtccgatgcagtcgggaccagcctgatggagcatattgccgaattaacgcatttgcatgatgaaatccacacggtaacggggacgattgccattcttctgatgtttgtacatgcttcatgggcgatatggacttatgtgaagggatctgccgaggcgaaaaggcattttaatcgttttagtatcgtcgtttggtgcatttggttaataccttatttaataggtatggccataggaatgcatttacatgcataaatagttatatgtttttgcattagatagacttaaaagagttccttctttcagctaactcctgcaaagaaaaaaatattttagtctcacggtctcactgtttttgtgtaatctgcatataattagtatattacagaatgagagatactttttaaataggtatctcatctttaacttgcaactttaaggtcaaatcaataagagaattagtataatatgtattcaaatatgtcgctatcagagagtaaataactctaccccaacacatcacctcaagcccaaatggaattgacacaaaaagaatgaatatagcaatcgtcttttttattatttcaagacgtaacgacagatcagatcttcctttaacccataataaattcaaattaatttggctcaaatgatcaaacatccaatccaaacataatatctgtaaaagaataacaaccccagaccatttatctgttaacaatagactaataataggattagccaaaacaagtaaacctaccattaaaggaaaaattatatatgaggataatctgatataatttcgatatgcgtttgttaaacatttatcatcatcttgaatggaacttaaaataggatacgctactctagaaactaaagcatttaaattattggaaggaaaaatagcaaattgttctgctcttgtatagtaaccaagctctacaacagaaaacttttttcctattacaatggtatacagattacgatatactgtattgataagacttgagatcaataatttagatccgaaattgaataatctttcaaaagaacttttggagaaagtatgtaaaggtttccaatgaactaaacagtaaaacaaaattgtcaaaattatactatttaagagagtttgccaaactaaagcccaaaccccgcaaccgacataagccatccatattccaatcacgcctgatataaaagctgcacctaatgaaattttagattgagttttaaagtttacagaaataattaatttcgttctgtgaatagccgataaagcatttattatcaacgacaatgctataaaacgaattacaagaactaaagtcggcatattataaaagtctgcaatcaaagaagccgaaaaaaacaatataccatagaataatactgcgacaagaatattaaaataaaagacagtggcaaaatcctcttcagttctatcttttttctggattaaagcatttgtaaaaccgctatctataaatacttgagcgacttgaagaaaaatagctaacatcccgatcataccataatccgatggtagtaacaaacgagctaatattatttgaattataaactgtactccttgtaaagagaaacgttctatagcgctccacattattcctgatacagttttctgctttagattttccattacttaaatacagtataaaaacaactacatttaccgatatcaattatatttttccaatattctcactaattggttattatcttcttcgccccttaccgcaattctaatatggtctctcccactaaaagcaaattaccctacacaaacattatctcctataactaccgatgcctttttataagaataaagaactcctaatgcatcacctcaaattaatattgccatatttgcctactaagcgaaagctacgaataggcactccagaaataacactttccggatggaagtgtataccacgaagggaaaaataaaaatgacgaatcttcaataatatttctgcaatcatgacatcggtaatgtgacgttataatgatttaatgcagcttttagtactttaaagaagttctcaatatcatctacttctatctctcctaaagcacagattctaaaagtatcctcagttgatatcttacctggataaatcgtaaatccacgctcataacaataatcatgtattttctcaaaatcccagttgggatcttctgggtattgaactgagacaaccagtcctgactgccattcacgctttattacacttttaagaccaatttcatttatacctgaatgaatagcctcaaaaactcttttgtgacgggcaaacttagcttcttcacccacttcaaaatattcatttaatgcctgacgagtggcgtaaatagtttgtaccggtggagtaaaatgcatttcacctgttctctcaaaattctcatactgcaaataaagattacaatagtaagaacgcttgggatatttttttgaaaacttaatctgttcctcattgcctataataaaagaaagacctgtcatcgcttgaagtcctttttgagcagatgccatacaaaaatccacattatctttctctatatcaaaaggaatcatgcccaaagaagaagtagtatcgacgacaaatttagcctgatatttatgagctatagcgcccatctcgcgaatagggttcagaattcctgtacccgtctcgtgatgagtagtataaaccatagctatatcaggattttcttgcaacacattttccaccaccgataaatcaggacgttcgtaaacggaaaattccaaattaatatgaggcaaaccataatattgacacacttctacagcacgggtactatatgccccattattcactataagcacccttttgtcttcaggaagaagagaatttagacatatatcaatattgatggttcctgagccacaaaataatacagcggtatgtttttccaaattcccatgagcaactctgaccaaatcgtcccgaagttgtttcatcatacctgcgaattctttctcgcgaggacaaatatccggaacaacttgtgccatttttacactgtcagtagtagtggcaggcccaggatttaataatatttttctttctattttcctcgatgaatttattattgtgttatttattaattgggcgataatttatgattagttttattaatatggcattaatattgccccattcgcagatggggcattttatgttttctagtgtatatttttcataggctaatcattttagtcaagtaatttaggttacttggatgaattgatagaacaaagttaggcatccagagttgattttttgcgcaaaaaaacgaaaaagtgtattcaaaaaacgcatctttctactctttggtagatttatttgctgaatgcaagtaccatttaaaaaaatcatatataatttcgtttgattcaggggttgggtcatgattgactctgttgctcatcgcgacattattacggtatcctaagagccggttgaccgctattgtatggtttagcgctatccaccggtctgttccgtcagagtatcctccggaaacaagaaatgggcgaggtgccatcagcgtatgcaattcatgcaaatcatatccttctttgcggagcttcggataaatgcctttagcataatcatgcccatttttgctccatgtattttcccatggtggcggataatatcccaaataccagggttcccagtaattgatatatccctcttttgtttcgtcgaatacaattccggggtctccccatgccgcacaagcgaacttttcgtataggcatgaggcaaacattgcccacttcccaccataagaatgccctgtgatgcctattcttgtagaatcgacgtcctgtactttggctaatacttcccatgcatttgcggctgcataagctaatgctgaaagtggttggagagttgcattttcaatggtggggtaataaatggaatatgtctgattctctgtggtcttcgttgttcctattgataatgtgacaaatcctcttttcgtcaattgatatgcaaagtctctataaggttttccacccaatccgatagccgtttcgggttcataaaatgtagtgataacggcaggctttttgccttctttgtccggaaccagcaaataaccttcagtctgttcgttgggagtccagtagaagcggacacggtattgcatgaagttttcacggtggagagtatccagaatttcaaatgtttgtccggtaatgacaggcggccattgtcctaacaggctcatccatctgtccttgatttcagttcgtcgtctttgccagtcttcaacggttctgactgtatccccattataatataataaaggagagcgaaaattcccatatacattttcgtattctgcgggcgggcggaagtagctcgataacttattccatagatcagaggagtcattatttccgctatttttgtttccgctgcatcctgctagaaatgctgccagatgagtgatcaggatgaatagcacgattttcttttgctccataagttgttgattgactttgagagttaacatttaccgaacaaagatatgccactttagtaatgcctccggtactaaaaacgaaaagctatattcgaaaaacgaataatttattttttatctgttcgtgatttttttctcccgatattccaaaggggaacatcctttgaactttttgaaaatccgggagatattattatagtctttgaatccggcttccgttgcaatgtctgccaatgaacgatctgtagtaagaagtaaatcggccagatggttgacccggcagtttaagatatactgatagatggaagtatgcatcgcatttttgaatttcacttcaaaatttctgcgtgagagcggaatctgtgccagcaaagactctatggtcaggtcggaattgtaatgactctctatgtattttacaacttcgagaatgtaagggtcctttatattatgcttttctgtggattgccgcaattctatgcggatagggttgatgacgatattgaaggtcccttcatgttcctttttgatttgttgatgaatgagcctgcctatggaatatcctcctctttctacttccagttctatggaggagatgggaggatcggaaatattgcagatcaagtcatcattgtcgactcctaacagggagatttcttccggtatgtgtatgttacttatcttgcaggtttccgaaatgaatagtgcgtgtgagtcgtcgcagcagaacaacgctatgggtttaggaagctcttgcagccattggcttacttctattctgatttcgtcttcatgcttatcggattcgaaacaataaaagttgccgcctatccgtttaacttcctgacggaagccttcgcaacgttcgtcagaccagacaactccgtttatgccgaaataagcaaagttgtggaacatccgcttggcgaagaattgggcggccattctgcccgttcctttgtagtcgcccgtcagattggagtaagtagtgcttctatggtgataattctgcaatacaatcggaatattcagttctttcagtagattgacggtgtcattgttccattgtccgatgatggcgtcagctttccattcttttgcccatttgagaatacctttttctccatacatgccgctgtaataggatggaagccgatagaaaagccaaggtccgttttctttggaatattgtacaagtccgcggagcaattttctgtcaaattcactggaataatcgatcagcagtagtatttttatcatagtgtgtgcgggtatattaaagtttatggaaacaaatatataaatattagtttgttttctttctataatagataaccgtatatatgtataataaaataagtactatgaaacagaaagtctatatgataatgctttttttaagtagcattattgtagtatcatgtaatcctgaaaaaaaaacatcaagtgaaacagtccgtaatcttaatccttcagaagaacctctgcaagagacaccgatttacaaacacgtagaaattataaagctggaaacgtctccagtttccctgattagtaatgtaaatcgaatagaaatgaatgattctattatattcgtatcagaatttggaaaattgtatacattcacaagagaaggtaaatttgtatctcaaattagtagaaaaggagaaggaccggaagaatatattgtcttaagctcgttttatatcgacaataaaaaacagcaggtgacaattatagataattataaaaatgtattaatcaattatgatttttatgggaaatatttatccacagtttctgtgccagcagggtcctttcagagttgtcattacacttttttgactgaagacaatcagttattaagtcataatatgatggatatgaatgatacagaagcatattctttattcgatatgcgcaaacaaagagtaaaacagtatttttcgtatcaaccgataactgtaggtaattatatgtatcctttttcttggcatccaatggcgaggagcggcaaagacattgatataattatgcctttatgcgatacaatatacacttattcagcagcaacatcttctttcgaaccgaaatacataatagaaacacctcaaaaaatgattcctaaggagaaaataagaaaaaatacaccttcctatactgaggatatatgtaagttaagcgaacaaggattctttactggatttactggaatttttgaaaccgaagcgaaaattttactagaatataaagatcaaggagttgttatgggatattttttgtttgataaatcgtctaaagcaggacattattatctaactacttggaacgagaagtatacaacattaccttttttcaacactatctatgcatataaaaatgtatttgtaggatatgcacaaccgagagatttattggaactggaaaatcttcaagacgaaaaaattcgtgaaagcattaaagatttggaggaagatgataatccatgtttgattttgtatgaacttaaatagcaatagagatgtggaaatgtggaacatttatattgttaactctgaatatcttattattgatagcattttatataattaataatggatatagtaaaaaagagagtttgttgactgaaaaagtcaataaactcttttatgagaatatatcattgcaagataatataatcttatccaaacaaggatattgtcaattagaccccgaaatgctattatatactaaagacagagatagcatacatttgtctgagatcaaaagaaaagaatatacgcttgttttaagatattccactcaatgttgttctacttgcgtagaggatattttgagaaaaatgagaaaatttgaagaacaatatcctgatattgacatcttattgtttacaacttatcgggtacaaattgaaaaaaaagattttcaacggatttgtagattttttcctaaagtctataatgtgttttcactaggaatacctcttgatgaagaggtagttccctacttgtttgtcttagatagaggtatgagagtaattgatacttttattcctgacaaggatttacctaaattaaccaatcgttattttgaaagaattacgacgactttatcaaggaataaagcatacaactataagtattataaaaaagaaatataatgaaactaatctttacgcttatctttactgcatatagcattgccgctatacctatatctgtaacgaaagggcctgatgggataaaaatacattgtctcaactctgcaaataatcctttgctaggatctcctgcttacaaaaatgtgagaattgttgaactggaaaaagttccttttttccagcggataaataatatccggaaactggaaatgaatgatgattatttatttgtccagacatctgaaaagctatatacctataccttaaacggtgaattaatggctgaaatcggaagaaaaggcgagagggaagatgactatagtgagctaagtacattttatattgataacaagaagaaacaaatcaccattattgatggtgttcaaaacaaattgatcaattataatttttggggaaactatatgtttacagatactatttctgaaggtgctttcaaatggtgctatcaaactttattaattaataataatcaattgttgaattatcatgggatgagcatggataacacagaaccttattctttattcgacctgaccaaaaaagaagtcatcaaacgatacttttcatatcagccgattactttgggcaattatgtgtatcctttttcttggcatccaatgacacgtgcagataaagatattgatgtaattatgccattatgcgatacggtatacacatattcagctgcatcgtcttctttccagccaaagtatattatcgaaatgactcagaaaatggcgcctaaaaataaaatcagaaagaatacgccctcttatagtggagatttattaaagttggatcagcaggggtacttcaccggatttgacggaatttatgagactgatactaaaattttgttacaatatatgtatggtataactttaggatatttcttatttgataaatatactaaaacaggtagtttttatctgtattcacaaaatgataaaggcaaaacattccctctatcatcatctataaataataatcaaccatgaaaaaagtagcaattttaattatattaataatggcaagcggactatctatgtatggccaaaacagctacaaagtcacttctttagtgaagctatcggatataaaagaaaagaacttgcaacgtgtattctatgttttttcaaaaaatgagttcctaaagctacccatcaattatgatatttcattctttgtttaccaagacaacaacagtatctctcgtgatgattttgaacatacgagagcagtaactcaaggtacatcttatagaataagcaattctccattctatgctaatcttgacaaaagagacaagagacctcccattgaaacagttctttctctcattgaagatactaatggaaaatatatcatgggaatagtcagaacttggtcagctcttcacgatatggataaacattggttagttacattcaattttgcaggagcaatcattgactacattcccatttgtgaatggcctggaacatgcagcaaagctagaaccatggaagcacaaatcaataaagattttacggtgaatgttcaacagttgaactttcctgaaaataattacatcattcagttcgatagtataaaaagaaattttatacacctagataacctgaaagggcaacgtatagatactaaatatcagataatgccggatggaaagtttaaaaaactggaagaggcatattatcaaccgcaaatctacactccggacatgttgaagagcaatgaaaccctcattcgatatagaagagaaaatattaaagaaaagaaaatatttcaacaataaagactatgaaaaacagtttaagaatcccacgaattatccaccaaacatggaaaacaaaagatgtaccttctcctcttgaccaactgccacaaacatggaaagaatatctcccgaattgggaatatatcctatggacagatgaaatgaacagggaatttgtctgcaaacatttccctgatttcctggagaagtatgatacatatccttgtaacatacaaagagcagacgctatacgctatcttctcttgaaagtttatggaggattgtacgtagacatggatttcgagtgcctcgaaaatattgagttcttactagaaggatcggattttatcgtaggtaaggaacccgactggcatgctaaacgctttggttttgaatatatcatttgcaacgctttcatggcgtcaacacccgataatgattttatcaactttgtatgccaaaggttaatcaatcattccggtgggaaagttgttaataacggatttgatatactggattccacaggccctttcttgctaacgcatgcattcaacgcatttccacataaagaagacatacgtatcctcgaatcaaagacaatatatcctatcggacaatgggaggtagagaaaataaaaaacaaccagattcctaaagaaatggaagagcgtatcaatcaggctcatgccatacactatttctttggtacctggtttggtaagtaacctttaaaaataaaataaataatgatcccaaagaatatacaccttatctttctacgcaaagatgaaccgttccccgaactattcgagaaatgcaaacaagaaatacaagtcaatcatccggactggaatatccgcctatataataaggatgatgcacaggatatattaaatcaagatttacctgaatacatcgaagcctataatgcattctatcacaatgtacaaaaagcagacttcttaagattagcccttgtatacctctatggaggattctatatggatttagatatgttaagtttaaagccacttgatgagttgagaaagtataatttggttttaggagaagagaaaattgtctgccaggcagagcaagaagccttgaatttaagatatcgacttcgaatagccaactatatgttcggtggaatccctaaacatccttttttacacagaataatggatgaaatggcagaaagagccacaataatcttaaaatcgcaacaggagattttagacataacaggtcccggcctactaacagacacatattgggataactatggaatgtatacagacatcacattattaagaaatacagataaaaggtgcaggcaaccttatcacaatgaaatctcatgccactttggagattatgcagctcatctgcatgccgggacatggagaacgggaatttgagtttatataaccaagttatgcaagaaaagctattttatcaacaaacactaaaagaatcattgtaaatttcttttctacatcaactgcaataaacgtaatgaccgggaaacaaatggagagcatatcatgggagttattaccgcaacatctaaaaaacatgataagataaaatggtcagagagtattgatactggtttgtcattgccgacacctgctgtactttcattgttcacaaacatatattatagaatgataatcagctacttatcttataccctaattatccatagagtactctgaacagacaaaatatatttgcctacatattggcactacaaaggacagctaatcattcgaaatccgctatatttggacacgttttgaatgacaaaaagcttcttgagcaatcattctttatgactgacaagatgcagcccgaaccggacaagaatactttctagatgtaaagtggtgccaaaaaggtaaatatccgtgccatttccataaagaagtactattctaaaccctaatagaattaattccattagttttgtataaatttgtaaactactaaacttgttaaataacacaatatatcctttcttaaacagaatatttaaatcattacgatgtataatgcccaagtattcatatctcattttagccataatcaaaaatctatatttatatcatccgacaaattgggatgcaattcattacttatcgaaatatttgcacatatagtgctatctgaactaaataaagaaacataacttaaaggcatgcctgtataagtgatgtatagattatttctgctccggctcattgcaaccataaacaatttctgagtaatattactatctccaggaatatataagtctgtatttgcaaatggaataaaaacattatcaaaatccaatccttttacaccatgataagtcataataacaatacgtttatcgttttccgcagctaataacgatccataactatttacaacgcattctataggaacttgattttcctttagatgatcattaagccgtttaaaataaggttcataatattgatcaatccatttttcccatacaggtttatgttctaactgcaaaacggtatcacaaaattccaatactttatctttagtaggaaataatattgcacaactctgattacgattaacaaacttacgtgcctccctcattatatattcgacttcttgatccacaaattctgctttgcataagcgtatttgcgtatctcttttaagcatatacctctttgcactaaaaatattcatcgatggtatcattttctgaattgcagtgattatagaacgagttaacctatatacgtataaaagtccccaatcttcagaatcaattaattgagtaattttctcaggaataactacagcttcttgatattgagggtcctttgaataaatagattggttactatctcccgctacaatcagcatataccttgtctgatctttcatctttatcaaaatacgagatgttaaatcttgaacctcatcacaaaaaatataatcatattttctctttgtttttaagaattcatacatcgtgacaattttcacatttgttatattcaactctgcaagttcagctttgcaaagttctatcaacgaatgagtaaacaccactaataatatttttgcattttgagtagcctcattattcaataagtatttaatggcatatacaagcaacaccgattttccgcttcccggaaacccttttatccaaatattctgaccaacataatgattatctttcagtttctttagaaaatccttttgttgagtatccaaactttcttctgtaggtattctagtactcataattagtctcctttcaccgctactgtattattagaattataaaaatcatccaatgatatcctttttgccttttttctgacctcttcagcaaaaatagactcacctaattcctctgcagcacttggtaaccaagtataatctacatcactgagggtaccattatcatattgagccttccatatattataagctttctttatcttttctactccttctattttctttccttcttttttttcatactttccaagttcaaataaaggatgtggcttattcgggcacattgctaaagattcgtgaatatattttaagaacattgaagtatcaatatttttatagcgataacccaaattaaaagcagaaaccgcatccttactatattcataagctttttctccgtaacgtagtgctttcctattatttcctgcagaagaaaagcagcatcctaatttattataactaatagtaccaggatataattcattacattcctcataagtttcagctgccttcaaatttagagttgcgttttcgtaagcttttgccaattccaacaaacattcttttgatggtactcctctattattagctgttgtattataagcttttttctctgctctcaatgctatcctctcctgtgaagttaactctttatttgcaaaaggattaattgcacttactaaacaagtttcacttccaaccttggcattaattgtcagtaatttatctgcagttaattctaattgcagcttaataggcgtatccaaagaaaatccattttgttcatttgaagttataaccaaattagtcaatattttattctcattactgatacaaatagggaattctacagttttttggccttcttttacaatagcaagattatctatttcaatagtatccgtcggcatgacagttccggcaggaaccaaagtcattagctgatcattcttagtaattatacatattggttcactggttattggctgtactatattctgtccaaaagagttatagatgaacgaatgaattgatgcacctttagacacacaagtctgaagatcaggaaataacaataatttggaatatggcaaccatgatttcagagcggcttgtacataaggattaagactactcccacccaccaataaaacataatcaacatcatctacttctaatctagccttacgaatagaagtttttacacaatcataaatactattatatatttgtttttctttttgaataacatcgcttttcttccttgtgaaaactttcataagttctgcgaattggatagatgttaaaaaaatctcatccatgtacaatacccctttggatgtattaattcgaatatcctttacagaaactttatattcttgttcaagacctgacaaatcgaaactatccctcattagacttatggctttacatatccttatttttaagttttccgcagtagtcaaaagagcatttatgatttttttcttctcagacataataaagatatccatatctaaatggttgtgagacaaaagttcagggtacaatatctcataagcaatgtatctatcatttaatactctatttaactactgtgccaagagtcctgtactttttatcataaaaaggaagttataaccaactttaatgaaaatagaagcaaacaaaaaaggcggagtttaaaactccgccttttttgtttctgagtgatgattaccacttctgtccgttgtactcatcagaaacagtcagtttctttctgcctttcgcacggcgagcagctaatactctacgaccattagccgatgccattctctcacggaaaccgtgtttgttctttctctttctgttagagggttgaaatgttcttttcattactgtatcttgtttttatgttattattctacgtaatcgggctgcaaaaatagagactttttttaaattaaccaagcgataagtcatttttgctcaaaagtttttgtgttttttactgatttagattacttttgcactcgaattacgacgaagacaattaaataacaataatataataagaaaaacagcagtatgattaatgctcaagacatcaaaaacggaacttgtatccgtatggacggaaagctctatttctgtatagaattcctgcatgtaaaaccaggtaaaggtaacacatttatgcgtaccaagctgaaagacgtagtaagcggttatgttctcgaacgccgtttcaatatcggtgaaaaactggaagatgtacgcgttgaacgtcgtccataccaattcctgtataaagaaggagaagactatatcttcatgaaccaggaaacttttgaccaacaccccatcgctcacgacctgatcaatggtgtagacttcttgctcgaaggtgcagtgctggacgttgtttctgacgcttctaccgaaactgtactttatgcagacatgccgatcaaagttcagatgaaggttacttatacagaaccgggaatgaaaggtgatacagccaccaacacactgaaacctgctaccgtagaatcaggtgcaacagtacgtgtgcctttgttcatcagcgaaggtgaaacaattgaaatcgacactcgtgacggttcttacgtaggacgcgtaaaagcataaatgtcatacaaatgacataaagaaacggtggatttgcttcggcacttccaccgttttttattacctttgtccatcactaaccctaatattaagatacaaaagaatgaaaaagttgatttacacactgctctttgtccttatttccgttgcagccaacggtcagcaggcaaagtatgtattctatttcatcggagacggaatgggagtcaatcaggtaaatggtacagagatgtatcaggcagaactgcaaaacgggcgcatcggcgttgaacctttattgttcacccaatttccggtagcaacgatggcaaccactttctccgcgacaaactctgttaccgactctgccgctgcgggtactgcactggctaccggaaagaagacctacaacagtgccatctctgtaggagaagacaaaaacccgattgaaaccgtagccgaaaaagccaagaaggccggaaagaaagtaggtgtcactacttccgtcagcgtagaccacgccactcctgccgctttctacgctcatcaggcagaccgtaatatgaattatgaaatcgctgtcgacctgacaaaagcaaactttgacttctatgcaggcggtggttttctgaaaccggacaagacgtatgacaagaaagacgctcccaacatcttccctattttcgaagaagcaggttacaccgtagcacgtggctacagcgattataaagccaaaagcaaggatgccggcaaaatgatcctgatacaggaagaaggcaaagatccatcctgcctgccttatgctatcgaccgtaaaagcgacgacttgactctcgcccaaatcacagaaagcgcaatcgacttcctgaccaaaggcaagaacaaaggattcttcttaatggtagaaggtggaaagattgactgggcttgccacggtaatgacgccgctaccgtattcaatgaagtaaaggacatggatgacgctatcaaagtagcttacgaattctacaagaaacatccgaaagaaacactgatcgttgttacggccgaccacgaaaccggtggtatcgtactaggtacaggcaaatatgcgttgaacctgaaagcattgcaatatcaaaaacattctgctgacggattgtccagacgtatcagcgaactaagaaaatcaaaaggcaacaaagtgacttgggaagacatgaaagaattcctgggtgaagaaatgggcttctggaaacagttccctatttcctgggaacaggaaaagaagctgcgtgacgagttcgaacaatcctttgtcagaaataaagtggtatttgccgaaagcatgtactctaaaagcgagccgatggctgcacgcgctaaagaagtaatggaccagatatctatggtaggctgggtaagcggcggtcactctgccggttatgtgccggtatttgctatcggtgccggttctcaactgttcggtgagaagattgacaatacggaaattccgaaacggatagctaaagctgccggatataaataaagaattgactgcacgaatatgtaatcaaaacactatttattttcatttaggcacggatttcacggattaacacggttctattcaattaaagaccgtgaaattcgtgcaatccgtgcctaaataatattatcattataatagatgattttcattgggtcccttctcttgatatgtttcctgtagtgtactgaataagttgacacttcaaaaatcgaaaataaagatgaaatattcgaaaaagaagtacaactattacagtgatgatgaacgaatgtcttatattcgtgagtatttatcaagtcccatatatatcattaatatactatgcatcaatattttaatattaaattttatatataaatttatatcttataaaacaaacactattttcaagaagcaataaataaccaattaaaaaacaaagattatggcattatttgtaaatcccggcaaagattgggaaaagaacatgagtgaagaagacatcgcacaaatggaatcacaaggttatgatgtaacagaactacgcgccaaacgcgcaaaatctgcagaggaagaagaaaaagagcgcctccgcgaaaaagaagagcgggaaaacttcaagaatccaactaacctgaacaaactcgccccttacctgcagacaccacgtgacatgagcacttcttttttcaaagctatggcaggcagcgccccctggctattcaaagatcgttggaaaagaaaatataccgaggctcctattgtttatgccgcggtagtgcaagctaataccgccctatggatgcccggtaataacgattattatcctgccgtatttgtttttgcacttgatcaaaaacacattcacgacaccgaatggctaaaacaaatagcagaagaaataaatgtattgcaagatgccgaccaaatccccggtgattgccgcaaactaatacagacattacgcgatgataccagcgaattctgttttcgtatcggcaaaagtgtatgtggtgacgccaacgcatggtgtgccacctataaattcgacaaacagacagcactgccacgcaaggctttaccatccgatggcatcgtcccttttctattaaagtccgccccggtagaaaatcaatttgttgatttcaaactaatcccgactgaattttatatcggctaaaaatagataagcagaaataggcaaaccgaaagtaaacaatatttttttcatcatttataattatatctcacataaggaatatgcatgcatacattatccaacaactaataagaattatattgtttatcactatcagtttgcctataggactaaaaagttttgcccaagaaacaaaacgtttctatatggaactggacactccccgcaatggagccaaagcaggacaagagcttgaattaaaatacatcagcacagccgatttcgattctgtatctccacccgacttcggaacgcttatagaaacagttgaaggagcaacaccacacaaagccggtcatacagtaaaaaacggcatattgacaaatatctacgagcagggattcagctaccgcatacgtttcaagaagccaggaaacaccaaactacctctggcatccatcaaggcaaacggaaaggaatacgaaacacctctgaccagtgtatgggtacatccggtcgataccaatatcgacagtgtaaaatgcagcattcagctggaggattcttatcgcaaaggagttttcactgccatcgtgatctgtctcttaatcgcctggttattgatccgcttatcgtttcagaaacaaaaaaaaataaagagacaggataaataaaacagagaataaccctatctcattaatccatcattatctgcatctgcttatttattttttaagtattctctttaaatgttcgacatctaaaagtaagttcactgtttcaaaatttcctttataaaaaacgccccagttattgaaaacacaaggcaggtctttcgctttttggagtgtatccacttgaattaaagatacaggaacgttatttgtatcacaatactgttttaccatttcaatcttttgataaatataagggcattgcatatcataataaatagtcagatcttcgctttcaattttcatttttttcgcgttttgcgcaaatttcggcattgtcccgtcaaaagaaagtgcaagcagttcatatccattatcagtcgcatcaacaacttcaaaaccgaatttcttcgcaaacgattggtcagaaagccagttcttccgcttctttgagccaagcatacaaacaccggatttgcctttttctttggcgtctgtcaggcaatattccatcaaagctcttccatacccattccccttaggacttcctaagacccataagcaatacagataataatagttatcaccaatgatgggaacccaagctgtctcaagaggtgcatactcaataaaaaccgtagcttttgcatttagctttctaaaaacatgaccttcatttagtctgtcggaaagccattgccgcttcgcgtcaatacctgcatgaggctttttactgcgaataatgcagcatagatgctcatcactgaggttttcctttgttaagtttacaaaatctgtattcatatacgcattcgttttaaattagatatcatcaatcaaccgatcttaacggtgcactctgccattttggctgaatataatagttatagtttcataagagatagtgatttagtattaaaatcctctttaaatctttctctctgccaaaaagagataagattcttttttgctcttctatagttggtatcttgataattaaattcccaatgaatatttcctcatattcttttacacaaacagactgccaaatatcgtttttcttaatttgaagatcccccatgacctcaatatccattaaaggaagtttgaatctggcaaaattagaacgaaacaaatcatcctcttttgtttccggagatatttccatatatgtttttagcaagtgttgcaatttgcatgaattcatttcggtagtcaaaatatcgatatcagcagtttctccgacctctatacctgataaaatcatagcagatgcacctataacataaaaatcaggacttatttcctgtaattcaacagttatacttgcaagactctgagttatcttatctttaattttcatatctccaataatttctgtatcatgaaaaaaaaatatgtgaagattatgtttttatcattgacattgctgacaattagcacaacagctacttatgcagttcaacccaaagatgataaaaaagaaaatgaagccttacaaacctcaacagaggaacatctaccattactaacgattaatggtacaaacgcatcatcatccttcattgtcaattccgaggctttactcggcaaagaaataacaattacagctccaaacggtttcaccgtaactccgactgttatagcagccaactctggaaaacaaaaagtgaaagtgaccttaaacagtactaaaagactgactgaagggaaaattattctgcgaagtggagacgtccgttcatatttaaaagtaaaaggatatggaaccgctcttcctgtgaaagacattgcagcatctcctgcttacaagaaaggaaatgataaggaatttaccaaagcattcactccaaattcaaaaggatatactatcgaattcaaaataaaaacagatgactcggagaaaagcttttatccttattttgtaaacgaaaaaggttatggattcaaagcatatattacctctaatgaaatcggattattcaatgcctacaaaaaagaaattaccaatcctgcaacaaatggaaaagcaggaggaaaaggtaagttctataataatgatggacaagcacatatttatcgttttgccataacaccagataaccgtgccttcatttacagagatggaattcctgtagattccgttagaattatagactacgctccccagccaaactttgcagagaaagttggcaaaccagtagaaaatcttttaaagaacccaaacttcgaaggagaatttgatataaatccagaaacgaagttagttagtagagtggaaggatgggatgttgttattagcgaccgttggaattcagaacaacaaattcttcctgaagaaattgataataatcaggacctggacaatcatgtttttgaaattagaccctataaatgggcagctggctggagtgatggtatcctaatgcaagtggtagatgttgtaccgaatgaaaattacacactatctgctctattaaaaggaggaatagcaaaaaaagaaggaaaactcaccggtaaaatgattatagaagaagtgcaagaccctgaaaaaaaagtcataacagaaattgccagtgacaactgggaaacttattcaatggactatactacttctgccgaatgtaaccaaattcgcgtatcctttacagtaggacgtggaggatggggaaatgatatcggagctgtccgtgtagacaacgctaaactgaccggcacatcacgtacatactcgcccaaattcggttttatagataatactgctgatgtggaatatttcacaattgacgaatctggagcctatgcccctgcacagcccgaaataactattaatattgaagactaaaataacgaaaacatgagaataactctatttatctgctttatgttctcattcacctctattttttcacaaaacacccagatcagtccgggtgttttgtggaatgacatagatggggagcaaattaacgcacacggtggatgtgtcgtttacgaaaaaggaacttattattggtttggagaagatcgtacaggttttaaatcaaatggggtaagttgttatcaatctaaagacttatacaactggaaacggctggggttgtcgatgaaaacgacaggtgaagccagagaagacatgaatgatatatcgcagggacgtttgttcgaacgtcccaaagtaatttataatccccaaactaagaaatgggtaatgtggagccattgggaaagtggagatggatatggagctgcacgtgtttgtgtagcaacaagcgataaaataatggggccttatgtactttacaaaacatttcgccctaataaaaacgagtcccgtgatcagacgttattcgtagatacagacggaaaagcatatcatttctgttctacggatatgaataccaacatgaatattgcattacttagagacgattatctggagccgactccaacagaaactaaaattttaaagggacttaaatatgaggcacccgctatttttaaggttggggatatgtattttggattgttttccggttgcacaggctgggaacccaatcccgggagaagtgcctacagtactgatatactggggaactggacaacagggaacaattttgctgtagataaactcaaacaagttacttacaactcacaaagctgttatgtatttaaagtggagggtaaagaaaaagcttatatatacatgggtgaccgttggaactctaaggatgtaggaaagtctcatcatgtgtggttgcccattagtatgcgctcaggctatcctgtcgtaaaatggtatgatcaatgggatttaaccgtgtttaatagtatgtatcgctataaaagagctgcagaaatcatacccggtaatatatactcattattagaaaagacctctgatcgtttagtgtctaaacctgccaatggtttcagtatagcggatgatgatgatgacatcaatctaagtctggagtttataaagactaatatacccaacgtatataaaataaaagataccaaaaccggaaagtttttggaatcactgttcggaactttacgcctgaatcccgagaagaaagatgatgctcaatgctgggtgttcaacctacaggaagatggttattatcagatacaaaatctgaaagataagaagtatgttacagtttccggttcaaatacatttgccggaagtaatttatatcttactgaactatccaagaagttaatgcaagattttgcagtatatttcgattccaataaatataaatataaggaaaataatgtagatttgcaccaaattaggaatattatgagaagagagttattatcattcgtagtttttacctcgactttatctttatcgctttcagcacagaccgccactcaaccttctaccgtagtggcaaaagcgaaaattgtgaaggcagacacgctttcgtcagaacttcagaagtatttaatgcttaaattgaatctgtccggagaaactcctaaattggacactgtatcaatcttatataataagtatatcggtcagttggactacctgaatgacccgtctgtaccggaacgttatattccgtccgatcctgactattttcgtctgtttactccgttagcctattattatgctccgatggcgcagtattcaaaggtggattggaaaccggtacagtttgactctttgcccgacaacttgaaaaagttgacagcggaactcctcccttatgatactttggcatatacgaagtccgagcgtgccaatcaatcggtcaataaagcactgatggctctttatctcaatcatccggaactggttgtcaccacggaaaaccgtatcatgagccgtgatgtctttcgtagggatgtgaaaccgaagatttctccgaaggcatctgttgtccatcttttccagccggaagaaatgagcaacgatgtgggcaaggcaaaaatgaaaatcagccgtcctaactggtgggttaccggaggtaacggttctttgcaaatcagccagaaccacctttctgagaactggtacaagggaggagaaagtaactttgccggtctggctaccttgcagctttatgccaactacaatgataatgagaaagtccttttcgaaaatcagttggaggctaaactgggtatgacatccacaccgtcggataaattccatgattacctgattaataccgaccagttccgtctgtacaataagttaggattaagagcgttaaagaactggtactatactatttcttccgagtttaagactcagttctgtcacggttacaaagccaatagcgaagaacttgtttccgcattcctgtctccggcggatttggcagtcagtatcggtatggactacaaattgaataagcagaaattcaatctttctgttttcatcggtccgctgacttataacttgcgatatatcgacaattcggaagtagatgaaaccaagttcggtctggagaaaggcaaatgctctaaaaacgacttcggttctcagttgcagtcaacgttcaactggaaaatcatttcggctgtttcgctggaatcccgtctgaactatctgaccaattacgaatgggtgcgtgtggagtgggagaatacattcaactttgttttgaaccgctatctttctactaaactttacgtacacgcccgttttgacgacagttcaaaaccaaccgttgaaaatggcagcttcttccagctgaaggaattgctgagcttcggtattaactataagtggtaattttttttaggcacggattacacagatttcacggtttcaggaattgaataactaaaaaccgtgttaattcgtgtaatccgtgccttattttatctctatgtcctcaacgttgaaatgatataccttcccggattatcaatctttccccacttggtggtagacagcgtgatccatatctgcgtccccttctttccgtaatccgacagcttgagaatagctgtaatttctttcttgtttgttactccatgttgtgccaggctgtccagaagtcctttgacgttgtgcgtactcttgttgtaggcataaccggggatttcgagcgaaggcgaagccgtattgtcttcttcctcttctgcttttcttttctctcctttactttgtccggaaatgtcagcaatttcgggtgaaatgttctcattttccagtttcaattcaccttgtactgacgaattgtttgcatcctttgtattattttccttttcctgtttttgggtgtcattgaccaacaggtagggcaaatcttctaactttcttttcctgcggcaggtagcatctatccagatgtgctgaatttcaagggaagtcaatatctgaaacttctcatagctttctttgtcaaagaatcctttgtcaagcaaaatttgaatgattccgtctatctcttttcctttcagttctcctcccagcttgcgggcaaaaatcaacgattgttcctcaccccatgggatgtaatatccttctttgaatattttacatagaagtttgcatacagctccatccactctgatgccatatttggcttcagccagttcaatggcatctctgtcgaaaaagtttacggtaagcgggaaatagtctacgcttaaataagttgtgctcatatcagtcttattgtttgtttttaagtttatacaattggtttccaatcgagaaaattctcaatctgaaaggttctccatcctttctcttccatgcaccagaatatgaaggtactgtgtacctgcttcatgtcataagagtggtgaaagtctttggaataagaaatgagagtgcctgtaactaactgaaaactaccgttctgtctgtaatatgcgatgatggcatggccatattgcatgtagtctgccagtgatttcactttttcggctattcgttctgcgatcgtttccgaataacctttctctgatacgatacgttttttccatacttctgttaatcgatctctttcttcttctgttttgttagtggctatcagccgtttttcttttgtcattacattataaatttgttagtaaaatagttatatttaaagaaaaggcggaactatctgtaggatgcttacactatcgtgcgatgatagttacactatcctgtcgggatagtgacactatcttgctgttatagtgacactataatttctgccggatagttcattatataaaatttaatgccatttgtatttctacttttatatcctcaaatattattggagtattatgtttcttagtatcattactttcagatgattcttcaaatgttgcctattcttgacttatatcctacgtttcttagcatatcctagattatagaacttcttaaacatctcccaaatgtagccaataaatccaattatgatgaatggtaggaaaggcagaagaaggctactccaaccatagcccaacacacaaccctacaattacgcctatgacatataaggctgttataattccgcaacctatcattacccctcttcctcctgccgttgcgtatttaattggagcattaggggtaaagaaatctggttctttattctctgattgattattattcatattagtttatttatagttacgagatattagtttaattcttatctttgtagtagaacttcataaaagctgctagttatgggtgttttattggttacaggaattttgaaggagataacatgtttacaagctgttgctgatgatgaagcgtgtaaatatggttacgagtcgtggatagcctactgttataaaaccaatatatttacaagattcattactatatgcccttgctgtaagaagtcatttactaatgacaaccctgctgttggtggacatgtacttgctgaatatggacgcctaaatacagaaggtagatttggttataccaagtgtgttactcctatctgtaagaagtgtaatgaccgttttaagaacaatcaagcttggaaagtatttaaagtccgtggttatcatttatgtcaagtacctaataagccacctaaacggtaaactttaacatcaaagaatatatcttaatgattaaatctaatagaacaagaatatagctcgatttcttgtgaagttactgattattaatctattaaaccaatgaatcatgttaaagtaagttaccgttacatttcttgaatatctcttcaatcagcttcatagattcttctgacctcatagggtcaggaattacttctctagagtctttgatacgttgcaattccgccctgtactctaacttctgcttcttaatattaagatagctccattttactcttttaatgttcataatttactatatcctaattcatttaaagtataatatatttaatggtcctaacaatatcattttagctataggataacttctaccttcccatgtaatcttggtagattctttaacaaagaaagtgtagtctattaaaagtacacttgatacagctatatgtattatcaaataccatttaacaatcttgataattttattcttcatttggttttaggtataaatatctccttaccattctcatcgtattctacataacaatcagtaagtccttctatgatgtaatctcttataatgcctagatgtttatctacttgtttagttatatattcagcattgtgtcctgctccgaacttctcttctcctactacattaacaataatcttattatcttcattcatgtagataggtctgcactggttacaaataatgttgataccttcatttacacaatcatcattgccaatagttattactaacgttgccataatcatttaaggtttatagttatactttccataatgtaaaattactctttattagaggattaaactagcgtaagaatgttaagtattgttgctgaattgttcatctgcttgttcgtcttctttagtagattctacatcttccatagaatcaaaccaatcttcccagtcttcccatgtacagaacgtatctgctattattacttctccagtttctaaatttgtgtcataacgtctagaaggagatacacattcatgtttccatttacctattatctccacataaggacctttcttctttgccataattatttattgttattattcataatcataggagctgttgtaccaaatccatacttattaaacttctcataaattcttcttattaatatcagaaagccattggaccgtgaggcatatttctaagctcctctaagctattaactccaaacattctacatagttcctctaaagtgggtatgtatatatcatcagtgaagctatctacacaaatacccaactcttccatgatgtccattatctcacttgctgtcattgtttccatacatccaatactctgctgttatcatattcatagttattcatctgcctgttcatctagcatatcatcatcttcctctcactctataaatgccaaaagctcacctgtcttggcatctcttatatatctaattccaggagctacatattcagtaactacctctttatcaccccaccatggtacaaatgtgttactcattatcataattcattcttattaatataggttagaaactcatatctgtaacttcatctgtacttccaaactctcctttacaattatacaattcctttatttcttcatcagtacgtataataccagtttcattaaggagttggaaattaccataattctcgtaaattggtttagtaagctctatatcttcatctctcatatcactaaagtcagtaacgtactctactaactttttacttgggtcactaaatctgttagcaacttcttcgtctttatttatcatattaattcatttaaggtttatagttattcatcttcctgttcgtctaaatcacttgaaccgtctgtcaaattactccaatcagtgatatatgacgtcaatttaactaatggctctccattactaatactagctttgacattagcttccattcgtttccatatatcttctagttcctgccactcttcttctggaaggtcttccggttttattactggatattttacttcatcattcattgtcataattgttaatagtagccgcagtaggaactccaactgctgtaccaaatccatacttgttaaatcttctcataacataatcctactcctgacgttcagaaaaggatgtagtgttttccgatccccttccttatagtcaataagaagatttttattcactagaatacaatattttgcataaatcaacaatttgttgtatctggtaattttgtaccctataaaatttaaaattgaagaatttatggctacagtaaaaattaagttcagaccatcctcggtggatggtaaagagggtacagtttattaccaagtgattcatgtacgtgtggcaagacagattagcacctcatacaggctgttccccgccgagtgggacaaaaggcgggcccgtatcgtcgccgctccgtccgatgagggaagacggcaacacctgtcactgctggagggtaagataatggaggataccgacaggctggagggtatcatcacaaccctggaacggagaaggggggcttttacggccgacgacgtggtttccgcctttaacggcggacattacagcctgtctttccccgtcttcatgcgggaggtcataaacggcctgaaacgcctgggcaagatacggaccagtgagacctacacctccaccctcaacagcttcatacggttcatggaagggagagatgtgttgcccgacgatatggattccgatctgatggtcgcatacgaggcatggctggaatcgggcggggtttccatgaataccatttccttttacatgcgtaacttgcgggcggtatataaccgtgccgtggagaaggggcttactgtccagcgtttccctttcaaacatgtctataccggagttgagaagactacgaaacgggcggtacccctgcatgtgataaagcggctcaagtcattggacctgtcatttgagcccgcaaaggcttatgcgagggacatgctactcttcagcttttatacaagaggaatgtccatggtcgatatggcgttcctgaaaaagaaggatcttaacaacggcatcctctcataccggcggaagaaaaccggccagcagctccttataaaatgggagccgtgcatgcaggaaatcgtggaccgttacaacatccccggatccccgtaccttctttccgttatcgacagaccgggaacagatgagaggaaacaatatatcaacgcctcccaccgtatcaacaggcatttgaaagttcttgggaaggaactggggatgtccgtccccctgacccattacgtggcgcgccattcctgggccagcgcggcccggagcaagaacatcccgatttcggtgatcagcgagggtatgggacacgattcggagacaacaacgaggatctacctggcctcgctggataccgccaccattgacagggcaaacaagttgattttgaaatccttgcagatataatagaatattgaacaaaaggatattcaggaggaattggagttgactccgttaaaaccatagactttgtcatatcattattaatgtatatgccgcaaaattaggaacttctaatctggtatactatgcgtcatcgcggagacctttacaataatgttgagtaaaaattgtcgtctcttcataagagatgtataattgaatgcaaaaatacacaaaatattgagaataaccacaaaaatgaacaaataatgggaataaaatatggactgatccttgaaactgccaaacaggctgttgagcaaagagtttcctagaagaaagcaaagtgcttattatcagattgttttattcacatgtatcacattatacatctcttatgaagagagggagctatagaacacttgctcaaaaaagaatgggacggttctgttgcacattttttacacttaaacggatacatttatggacggaatattaagtcttgtttataaattaaaactgatcgggcgacagctaccagatggcacaacacggatcaaagacataaattagtttgagcgacgatgtcactgtatagtacagaaactcaacctaacgccatggggggcaaagcggagaacggaccagagacgatttctgatccggaggtaaagaaatataccggaaacaaggagataacatcctggtgctatttgtttatccatcatgccaaagtagaaactgtgagcaagaaattgcaaacagaacaataccgtatctttgttcataagagtatcgtctataaacgtgggaacaagcggataaagaaagaggaacaggcaaccatttccggccttgtctttatccaaggtgacgctaacaggattcaaaaattcttaaaagagaactttttcaatttatatttagtgaaggattgcagtaccggagaaatagccgccatacctgacagtgtgatgcaacctttcatgcgggtgtcggaagttattcccacccgtatccgtttcatgccccactcctttgattattattctgtggggaatcctttagtccggattacttccggtatcctttccggccttgaaggatatcgcatcagaatctctcgtgacaagtgcctggtcacttccattggaggaatgacagtggccattggaggcatatataaggagagtttcgagaatctggacgaatatgtccgtctgcggaggaagcagctggaaaaaatcaggcaatcatcgtatgtcacattcacaccgcttcaaaaggaaatagacggctgtttttttacaccccaaaatcaattggatataatgggcatggcggaaaatctcacgccgtgggttacaaggatgaaatccgatatggtaaaaaagaactttgatgaagcggtggaaatagcgttcttcctgcttgaagaaacaggaagctatttccggagtatatattacgattcccatatcggagacatgaaagacatgatgataatatgtgaaaaagcggatcaaattctggtgtctgttataaactgcatggatatatctgtggatttgaaggaaattgtagaaaccggacgggagtcgctggctattcgatatccgtttctgccgatagaattgtagatggtaattataagtaaagttttaagtactacattttttttatttgatgtcaaaaagtagtataaactgatataatatagatttcccgagagtgaaaagatgcctttcatgctttcctggcattaatcaaaagcaaagttgtcattcacttttattagtgttaatttctttattccatatttttattgtatgtttgtgagcatatagcttcttgcagcaatcaagaagttgtataaattaatcaatagcaaacaaatcagagcatcatacatagacaaaaacaaaggacaaatgaacccaagtgaaacagaacctacccaaaatgtaatgtcatcttcagcaccagaaacattccctttaataaaagatcaacttctatttgcagaaagtatctacgcttgtctgccaatgagtattgagatctatgatacaaatggtatcttgcgcagtatcaatgaacatgcattgcagatgtatggagtcactgataaaacgactgtagttaatatcgtcaatctttttaatagtccttatgtggacgaaactctcaaaaatcgcattcagagaggcgaagatattgttctggaattcgaatacgactttgaccggataaaagacaacgcatacttctctacccaaaataagaacacgatcatttatgaagcaaaggtcgttcccctgcgaagcaaggagggagaaatcatcgggcatatattgctttccaacgatgtgactgccataaaagaagctgaattccgtacggatgaaagcaaaaagaatctggaaatggcaatggaagcggcctctatgtcgtcttgggtatatgacgtgtataaaaaaacattcaatccattacatggagatcctatagctaaaaaaaacacgacattagatcagattctaaatatactgcatccacaagatcatgaacctttaatacaacttttatcacaactgaccaacaaagaaattctgcaaggaaacatcaccttacgtttctataatgaagaagaaaagcaataccgctattatgaaagcatgatgcggttatctttcgaacattttgggaaattgctgattataggaacccaactggatataacggaaaggatgcaaatggtaaagaagacgcaggaattaatcgccaagcgtgaactggccatgaaagtcagcaatatcattcattgggatttcgatgtacggactcaagagttcgaagcctataatgacccgatcaatgattatgccagtgataaactggtgagcatccaacgatacatggatgttattcatcctgaagaccgttcttcatcctatgatgccatacagtctatgctatcaggcaaggaactcaccattaacttcacttgccgtatgcaaacgaagtatgatgaatcctggcaatattgtaatatcataggcgttccattcgagaaagacgaatatggcaacaacgtacgatataccggtttcaggcaaaatatctccaagcttcatcagctgaatgaagaacttgaagaaagaaactacaaaatgcagctcaccttcaaaactgtaggcatgtcttactgggattttgaagtaaaaagcaaacaattcaaagcatttaatgaccccgtgaatgacttccattctgaaaatgtaatcacacctgaagactatctgcatgtcacccatccggaagacatcgagctggtccgcaaccatattaattatatgattggaggaacaactaaggatctcaacttcaaattccgatccaaaactaaatgggacaaagaatggcagactctcattgttaccggcataccagtggaaagagacaagaaaggcaatgtaattcgctacaccggtattaaagtcaacaatacgaaatgggagaaaatggcacagcaactaaaggaactgaaagacaaagccgaactttccgaccgtctgaaatcggctttccttgccaatatgagtcacgaaatacgtacgcctctgaacgccatcgtcggcttctccgaactgatggtatattctgaagatccggcagaaaaagaagaatacatgagcatcatccaatccaataatgagttgttattgcgattgattaatgatatcctcgacctttccaagattgaatcgggaattcttgaacgcaaaagagaaacattcaatttagccaaagtatgcaacgagctttataccatgatccagccaaagataaccaatccggatgttgagtttcaaatggacaattccggtccggactgttggattttcctggatagaagccggctcaagcaagtatggatgaactatcttacaaacgctgtcaaatgcaccaaatccggatatataaaaatgggatacagcatcgaaagagaaggaatccggatctatgtggaagattccggagtcggtatcccggaagaattacaggaacgagtgtttggacgtttccagaagctcaatgagtttgcccagggcaccggactcggactggctatctcaagagctatcattgaaggagccggaggagaagtcggatttacttccactcccggtattggatcgactttctgggcatggattccttgtgaaatcagcactcagaaggaacataccccaactatttcactgccattgcaacaccagctttctttgaacgaaatcgacaagaaggaactgaagatattaattgccgaagataatgaaagtaactattcgttagtgcaacatattctcaaaagctaccatctaacccatgttcaaaatggagcggaagcagtaaataaagtacgtgaggaagagttcgatcttgttctcatggatatgaaaatgcctgtcatgggaggactggaagcaacccgcaaaatccgtgagtttaataataggatacctattattgcacttacagccaatgcttttgatgctgacagaatcagcgctcttgacgcaggatgcaatgaatttcttgccaaaccattgaagaaaagtcagttgcttgaactcttctcaaagaaatggtaagttatatgttaacatacaattataaagtttatctaagtactctgatagtattgaccgtttataaattcataaattaagttgttcggttctttttattgcccggattcaacttattatttatacctttacatatttgcctgtttatcaaatcaatatagtatacagcaaagggggacatagggggacatttactgttttataggggataatcgcaatatgaaaccactcagaattcaataaaattgatgtaccccaaacaaaagaaaaacgttgactattattaaataatcaacgtttacatcagtgattccgaagcgattcgaacgcttgacccacgccttagaagggcgttgctctatccagctgagctacggaaccatccttatttgcggatgcaaaggtagtgctttttgcgagaactcaaaaacttttcgacacttttttattcatatttttctttatagctagaaatcagcaatttataaaagtactattcagaaccctgttctagggttgaattattttttcttatcccgatatcccatatatcatatatcttatttatctttgtgcctgtcaaatataaaatcaaaaactatgttgagtcgtattatcgtattggtcatagccggagttgctgtcgtttatatcgtccgctttatagataacttcttgtcccagcacagaagaaaatattaaataagatatatatccaatcaggagaagttcatttaaaacttctccttccgttcaaattcaccttcttcggtgtaatacttccatgtgcctttaggctgattatttgaatatttcccacgaagcttgagctttccattttcgtgatattcacggtaacgtccgtgacgttttccctctttcacttccgcttcgcttttcaatgctccttccggatagaactcacgcagaacatttccttcaaacttctcaatatagaaacgctttaactcactcatctgctccttttcggtcacagcttcttcatccatatcctgatcttcctcatcgctgacaacggccaccacctcttccggctcgtacggacggtaatccatcacatactgcagagaagcttggttgttatctccgattacctgcatcgtccagtaaggaaatgaatacaagatatctttattcgattgtatttcattccatgtagcgggattcatcataggtttcaattgtgagtagaacttgtgcatatctgtatacaagaagattgtggaacttgatttcatatacgaataagcatccttaaatcctgcattattcttcagtaaattcttctgttcgtaatcttctacaaaggaaagcaaggaagccggtttattgctgaaaacgacataatcatccacataagtataatatggcttctcaaatttatcaaacagctttccgaagaacagacggaagaaacctttcatttcaacataattgatttcaaagtccttataattaacagactttatcttaaccggagaccggcgtttgatcttcttttcaataaactccatattcttacgggcgtctttgatgctttttgcccgaatagccagaatcacttcaggatcatgtcctaataagcccggttcggattgcgttatggcaaactctccggacatccagctcaggaagttctcttccagagaaataccaaacaggctttctatctttttccgcgaactctgataagagtcatacaacagtttatcatgaacagacagagcgttctctagttccttcacgaaagttaccggactatcgaagccgatatttgtataaagagccgttcgcccggacaaaatctcgtgagctttcattttatgctttcccgaattcagcaaggcagtgatataaggatccaccgaatctttcttcaacgtataacctttcacttccatccggtccttatccatattcaggtaaaggcccgcaaaattcatagaattactgaacagatcgacatattcatttctcgctcccagataaatggacataaactgaggaatacgggcatagttgataaataccctgacaagccctttaccggaaactaatttttccgtttcaataaaagactggtcaagtccgatcttaggcttattacgggagttgatggcagattcaacaaggccggaagtataagagcctaccaggtgattatccacaaaagcagtataaaagacatcacgggtatccggatcacgcatttcaagaatgttaattccattatgcattcgattagtgacggtaaagccggacattgccagcactgtttcgacctgatccttcaataaatccattttagaagctttctgcatatctactataagcagaaaatcccaatcggtagcgcgggtcttatgaagtgagataagcagatcccgctgaccgaccagtgataacagtactttattgcttttgacaaccgagtcaagcttttccacgctcttcgcaacttcttcaaatgatttcgcttttctcagacattgccaggtttcgcttccactaaacttttcccagtcttctatcggagcagatgactgaatgataaacgctgcatcctctggcaccagatagatctgctgaatattacggtcgggcgaaataaacagataaacgatggagtataccatgtatacagccaaagctagtcctgccgtaatcaaagttctttttacaatttttcgtgtattatttttcttctcatttttcccgggttcgacatattgcccttgttccccattgtttaattcatccattatttatttgttattgagttgattgggcaaaattactaaaaaaaagatggaagatgaaattcataggtcggtttatactttaaatcttctcatccacctatatccgccacagatcacaactactccatcttcttagggaatgaaaggataagataaaatcgtgcgcagatgaattggaataaagttttttaaacaaagacatctgcttaaaacaaaaaagggacaagaaaaaaaagtagaaaactaaaataaccaacttgcatactattagtgtatattcatcaccttttaatacatataagtacattattatatcacatatttatatttttattttaaaacacaaattcatcattctatcttacatctataaattccaaaatttcatttacaatatactttgtgttaacctaaggcaattatacaactatgtactatgttgctatgggtggctataaacgccttggcacagcaaaagattagtgtctctggtattgtcacagatgagaataaagaaccggtcattggtgctaatgttagtgtaaaagatgtcccagggctaggaacaatcacagatctcaacggacgatatgtaattaaagtggaaccttacaatcgcttggtattttcttatattggttatcagtcacaagaagttctaataaaaaatcagtcaaaagtaaatatagtactaaaagaagatgttaccaatgctattgacgaagtggttattactggtactggagctcagacaaaattgactcagacaggggctattacaacagtaaatgtagatcatctgaaagctaatccgtcttctagtatcgtaaatacattagccggtaatgtcgctggtgttttggcaatgcagacttccggacaacctggtaaaaatgtatctgagttttggattcgtggaatttcgacttttggtgcaagtactagcgcgtatgtcttggttgatggcttcgaacgcagtatggatgaaatcaatatagaagatattgaatccttttcagttttaaaagatgcttctgccactgctatttatggatcaaaaggcgcgaatggggtagtattgattacaactaaacacggtaaagccggtaaaattaatattaccgcaaaagcagaaacgacttataatatgcgtacgatcactcctgaatttgagaatggggtaaattatgcaaattttttaaatgaagcacgtattactcgtaactatgaacccgtttaccagcctgaagagttggatattatccgtcttgggttagatccagacctctatccgaatgtggactggatggatttactattaaaggagggagcgtggcaacatcgggtaaatctgaatatgaatggtggtggaaatactgcacgctattttgtatctttcagttatttggacgaacagggtatgtataacacggatagctcgttaaaaggagattataacacgaacgctgattatcgccgttataattatcgcatgaacacagatattgatattacaaaaagtacacttctcaagttaggagtttccggttatttatccaaaagaaatagtccgggattgggagattctgatgtatggggagaactttttggatatactccaataagaactccggtattatattctaatggctatgtacctgccgtcggtacgggtaataagactaacccatgggtagcggctacccaaacaggttttaatgagaattggaaaaatactattcaaactaatgtaacattggagcagaaactagacttcattactaaaaatctgaaatttgtaggacgttttggatatgacacatataatgataatactatcaaacgtcataaatggccggaacaatggcttgcggaacgagctcgcaatgaagagggtgaattagtatttaaaaagatttccggtgcaggaaatatggcacaggagagtagttcaagtggaaatcgtcgtgaattcttagatttgacgttaaattggaacagagcgtttaaagcacatcatcctagcgcgacattgaaatatacccaagatgcttttgttaaaacggttgctttgggagatgatttaaaagagggagtgagtagacgaaatcaggctttggcagggcgctttgcttataattataactatcgatattttgttgacttcaattttggttacaacggttcggaaaattttgcgaaaggacatcgttttggcttttttcccgcatattctctggcatggaatattgcagaagagaaaataataaaaaagcatctgaaatggatgaatatgtttaaggttcgttattcttatggtaaggtcggtaatgataatgtaggaacccgtttcccatatctttattcaattgccgataactataaagaaaatgatcagacgaaatattatgcaggttacaactgggccacttatggaagtaataaatcttataatggtttacgctatacaaaacttgcttctaatgatataacatgggaaatagcaaccaaaagcgaccttggtatagatatggctttatttaatgacaaattcacagctacgatcgactattttgatgaaagtcgtagtggtatttatatggagcgtgcattcttaccaggaatggttggtctggatggcaataaaccttatgctaatgtgggtgaagtaaattcaaaagggtttgatggaaactttagttataaacaaaaaattagtgatgttaagttcactgtacgtggtaatatcacatatagtaagaatgaaatcatagaacgcgatgaagagaacaatgtttatgcttatcaaatgaaaaaagggtatcgggttaatcaaaatagaggcttgatagctttaggattatttaaggactatgatgacattcgtaacagtcctacacagaaatatggtcctgtaatgcccggtgatattaaatataaagatgtaaatggtgatggtgttgtcaatgatggcgatatcgtagctattggttcaactagtaaaccaaatctaatttatggtttaggtctttctgctacctggaagggattggatgtaagcttacatttccaaggtgccggtaaatctcagttctttacttatggcaaatgtatatgggcttttacagaaggacaatggggtaatattcttaaaggaacgctggataatcgttgggtggatgcggagactgcacaaaagcttggcatccctgctaatgagaatccgaatgcatcataccctcgtttgagttatacggataatggtaatggtaatacaacgatctatgaatataaaaataattaccgtaattcgacatattggttgcgtaatggttcatatgtccgtctgaaaacgattgatgtcggttatactcttccgaagaagatcgtgaataagatacattttaataatgtacgtattttcatgacaggaactaatttactgacatggtccagttttaaactttgggatcctgaaatgggggcttcacgtggtgagcaatatccattagctaagtctataaccattaattctgtttattgttactacaaaccatatattttgtatctctgatacagagttgtcatagtaactgccttaatggggatgccgtttacccaatctaatattccatatgcatcaggaatatagtcatcatcatagtatgcaaagcaatacatagatgttggattatatatgtaccaaatattagtgttggcatttttgaacttgtacatacctttctcatccacattgtttatctggaatgaaagagtagtctgtataattggatttatagtcttattgggatctgctttaatttttaattggtagtatttacttttctcatcttttattgcattacttttggtaagaaatgttgcgggaatgctgttagcttttaattcttcatcggattgactagcagcatctgggttcgagaatataagcttatctccttgtcttgtattgagcacaggaacaatatcatataatttttctcccgaattgcttttgcgaatatacatctttataatctctatatatggttcttcaagactctcttgatattgaaagtccatgtgagtatcattatatctttgtttaaaattctcttccaaaataaaatcggatatgggatatagtccaccatcttgcagatcaatcatagtatgtgttttgggatcgtttaacgattgcagccaaggggttaaatcaatagaatagttcgtaatatcataggggggagttgaaatgctgtaaccatacgctccaccaagagttttgatggaatatgataatgcggagaatttgttggttattgtttctgagttttctctctttgttccaatggataagtttcctgaagcagaatgaattgtgtcgcttggagctgttggctttttatttttccattcataggatgcatttatcgctacatccatatctttctctttgctgtcgaattgtatactatttgtgtcaactccgtaaaaaagtgctgaagcccgtcctcctgtatagtagccagttaggacaaattctccataactttgcattaattccaccatagatgaattatataatgcatctacgaataattcatctaaataatcagctgcaatttttctcaatgcactaggtgctgtttgcaagtttaacattccattgactacctctatactgagttctccatggactaccttctcactatcatctgtattatggacaaaggtctctttgatagttttttgtcttccaaatttgaatggtccaagatttagagaaaaaccggactttactgttttagtgaaagttttattcttctctaaacgatcgaaatcagaataagataaagcctttgtctctgttgttcttagttctttgggattgatgtatgaagggtacctttcgagtaacttcttcatgttgacaaccgggtatttggcgttagcgaaatcaccgataatagaagttccattttctactgcataagagcatccaaggaagtctgtagcatcggtgaaggatgctcttgtcgtgactctttgggctgtttttttcgaccacactctaggtaaactagagttacgttcttgcaagatgatttctgatgtggaattgctttgattatctaccggagtataattattagtttcctcctcattagtgcatgatattgtgaacaatattatacatagggatataaataacttcttcattttgcgtataatttaaaaagtgagtggtgatgattgagtaacgtttttgatgttagcttttccttttgcacttcgttgagtatctaagtttacttcttcataatccggttcggctatttcatcaacatatattcttccgctccaacgtccgggtagtttagcttctctaatctctttatctttttcattaaaatattcgatagtagcgacataatctactgatacatcataagctttaaaataatatgtcagtgtgagctttgtacgcggtttgactgctacaggaatttccttatatagtgttctcagtactgttctgcggatgccgggctcatatttcgtatcaacgggaactttattattaggtacaaggtctatttctcctaatgttacggtggggagtgcaaattctaggtccgatgccgggacttgaaatgcaatacctttctcttcttcaaaataagaattgtctttcatttctttaatgaacttcagattatcccgcttttcttgaaatgaaacatttgtggttgcttgttggatagaaatattttctctttgaattacggtagcagaatatggattaataaattcgagtttctttagagtgaatggagcattgggagtgatggtgaactcttgttctgccttttgtgagtattgactataacccagattgcttccttgtacttcaaccacatagttaaaaacatcccaccaaccgccacttccttgtccgatatacgattcactttgaataacgtaccctcccggattattgcttgcgggtataatatcccaagaagcagaaaactcattcggggagttagtagtcatggctaatacgactttctggtttggattacttgtatagtgacctacagccagaggtgtttcagattggcatgaataaattaaatagggaactcctacaattgacggggggattgtaacataaaattgtttgtaaatatctgctctacggccatctacatctactttccctcctctgccactagctgtaagataacctccgcttgttgctctcaatgtaaaaggcatttcccgaatagcccacatgttctcagaaaaatattggccgtaattactggaagccgctctagtctttgttttctttagttcatccattctttcttttaatgcttttaactcgtctgtcattttaagtggttcaagactatcaactgacagtgcctttgtctctgcggatgtaactaattcttctgacgaggattgaatctcactttcaatttcattctcacatgagaataaaaatagtgcgctgcaacacaatgctactaaaaatctagaaatgtttttcataaatattatttttataggattaatattggcgttatgacaggacaaatgaatcgtctttatatgtgttgatgtctactcgatttcaatataatattatacgattttcgatatgacacaatgcccattggttagtatttcttgtctgacctataatcatgctccgtatttacgtcagtgtttggatggttttgtgatgcaaataacatcttttccaatagaaatcttaatttatgatgacgcgtctggagatggtactcagaatattattgaggagtatcagaaaaaatatccggatataataaaaccaatatatcaaactgagaatcaatattcaaaaggtgtgaaggttggttttgtttataattattctcgggctaaaggtgagtatatagcattttgtgagggggatgattattggactgatccttataaattacaaaagcagattgattttttagaatgttactcggattatgttatttgttcacatcgatacagaatatgtttaaaagaggagaaggtgatgaatgatgagatcaaaccgattggcgatttatctgatgggatgtcttttgatttgtctttcttgattcgtggaggttggttatttcaaccattaagtgtcgtataccgaaagtcggcattggatttggatacatactcgaaatatgcaatatatatagacgttgccttgttctatgctattttgaaaaatgggaaaggatattgtatgcctgatgtaatgggagtatatagaatacatgaaaaaggggtatggtctggactcgacttaaatcatcaaaggatcttttctttgaaagcaagagaagctatttatgatgtggagaagacggatgaggctgcaatgttcatcctctcacaattctctcgtccaatgggacggtttctggttgtgaaagagtgttctatgtttatgagaatcacgaagatattaatttcccattttggtttacgttttgtattgagaatgtggtttgatagactattcttaaataaaaagttgtgcgtgaatgagttttatcagataaaggatttctgcaaaagaaagaagaatggataacattataatagtattaaattcaaatctgttactaaaatgaatatagcattgattattgcagggggatccggcaaccggatgggacaagatattccaaaacagtttattcatgtggataattgtccggttattgtacatacaatgttagctttccaaagacatccggacataactgctgttgctgttgtttgtttaggtggatgggaaactgtgttgtcttcatacgctcatcagtataatgtatcaaagttacgttggatatttgctggggggataaatggtcaggaatcaattagtaacggcatatacggtttaaaaaagaacggtgtcaaaaaggatgatctggttttgattcatgatgcggttcgtccactggtatctcagagtattatatcttccaatatcgcaatttgtaagcagtatggttatgctatcactggtattcagtgtagggaggctattttggaaagtgatgatggcttttgttctgtgacaagtattccgcgtgataaattgataagaacgcagacaccccagacttttcggttagaaaatattataaatgtccatgagcaggcaaaatcaaaaggtatcataaactcagtatcttcttgtactcttttggcggaattgggcggatatgaaatgcatatagttccgggagaggagcgaaatataaagattacgactacggaagacctggagattttcaaggttttgaggcaaacgtcaaaagaagactggctgaaatgatgacttattatgacgatatcagaaaagtgcaggatttgcatctgccgtgggaaattctgactgatataaatattctgattgtgggggcctcaggtctgataggaagggcgttggtggatactctgatgcagttacccgataagacgtttcatctatatgcaggtgtacgggatttggtttatgcgcaaagttgtttcatgcgatacaaggatgatgaatctttcaccttgatacaatgtgatgtgacagcattgattccatttgatattgattttcactatattattcatgcagcgagctatgcggggccggccgcctttcataatgatccggtcggggttatgaaagcgaatatattgggagttgacaatctgttttcatacggagagcaacacaatctaagaaggttgttatatgtttcttccggtgaagtgtatggagaggggaatggaattccttttcgcgaagaagacagtggttctctcgattgggcttccttacgcgcatgttaccctgcggcaaaacggactgctgagactttgtgtattgcttatgcagctcaatttcagatagaaacagttatagcacgtccttgccatatttatggacctttttacacttcaaaagatgatcgtgcctatgcgcagtttatacgaaatgtattggcaggtgaaaatataatattgagaagttctggtttgcaacagcgttcctggtgttatgtggttgattgtgtgtttgcacttctttacgttttgctaaaaggaaaaacaaagaatgcttataatatagctgacgtccggtcgaatgtcagtatccgcgaatttgcggaaatgatagcactgaaaagtgaacgagaagtaattttcgatttaccggataataccgggaagaataaacctattatatcacaggcgatatttaatactgagaaaataaataaaataggctggttcccccaatggaagcttgaagaaggcgtttcacatacacttaatactttaatatctgttgatggaacatatatataagttgctgcgctcttttaaatgggactgtgctaaatatctctacaagaatactctgaactttaaagttaagagattaagacgaaagaaaaatataagagttctgtttgctgtggcggagagtgctacctggaaaagcgattgtctttataaagcgatggcggaacatcccagatttactccttctattcttgttttacctgatgaacagaaggaaaaaactctgttgaaagaagaagttgattcatgttttaatttattttgtagaaaagggtatgcttgtacttatccttatcaaaatggaaaactgattaatattcggaagaaattgaaaccggatatcattttctatcaaaaaccttatactttttatcctaagagtcttttgtattataaaaatatgtccaggatcatttgggtaataaccgtgtggttgtagaccagagtggtaatgttgaagaagtgaaccattattatccgtttggcggtctgctatcaagttcggtaagtaatgctgtgcagccttattagtataacggtaaggagctggataggaagaatggtcttgattggtatgattatggggcgtgtatgtatgatgcagcgcttggtagatggcatgcggttgatccgatgagtgagaagtattatagttggagtccgtatacttattgtaagaacaatcctgtgttgaggatagacttagacggaaaggatgattatgttatcagcagatcaggaagattatttaatgagactcctattgataagagaggtaaaggctcaacagataatttatatctttccagtgatcgttctatttcagtaactgtaaatcaggggttacttggggaaatgcatagtatgcaggcgaaagagcagaaggaaaatcgggtgaagaaatcttatggaagtactcaagatttggagacagctgctactgtttttaaatttgctgctgatcacacaactgttgaatggaagttagatgtttatgatgataatggtacaagaacagctgttgttgcgacagatcgagatccatatggggtagataatggtgtatatgctcaaaataaactttctgtgaaaggagaaaaagttatagatattcattctcatttgcccggaggaacgaaaggtggagctggtaatgattttaacttagctaagccacaacgtaagaatgctgtgtatatgaaagataaccgtgtgagtactgataaaaaggatatgatatatgaatataccaaaaatgcaagtcgggtaaattctattcgtgtatatgatgctacagatttattgcaatatataaaacgtaaatgatatgcttatgagaaaattagtctatgttgttctattaattatactggggggatgcatacccccctccccttctttggaagatattcatcagcgtgtagcaaaacaggtggaagtgctgatagatagtggctatttacttacgacatatatagaaatagatgaagtgttttcgacagattctaattcactttattatatcggtgaatcagattctcctggttctgatggtgctgagttaccttccagagtgataaagtataaagaaagatatctttgctttatcgaattagatgagcctgaaatgtcacgcacagaattgtttgagagaggttttgtttcggactctaactttcatgaaaatttatgtttaaacagaggtcgtgattggctgttggctcttcgaaaatatgaagataaacatatcttagtaaagatgttgcctaattattatcgtctatttgaatatccggaactttggtcgtatttttctggagatataccccaggagaaaactgcattgatgggattgacttcgcacgatattattgttcccagttcatatattccggacctttttgaacttgagattgatagtctgaagaattatgtagaaagattctcaggagaaatatttgtaagaaatcagactgattccgttttgctattatcgaggaattcagcgaggagtatgtgctatgctgtaataaatggaccggatacattaaaattggttttgagggattcacttccagttgctattgcccctcatgattttaaatccttgaaatatgatagtgaacctccccattcatttcttcagaatttaccggataaggatatttggatgtctatgtataagctgtttagcgattcgactttttgcttcttgaatattaataatatcccacagaaatttagaataatgcataatgatgcagtttattcgagtgacttaagagattctttatcaaaaagggtaaggtatatttataataaaggggtttatgataaagaagagagaatacgacgtttttttaagtgggattagaattacagcagtttaaatgaagttggctatattgaagatgggcagtattctttttatcttcaggatcatcagggtaatagccgtgtggtagcaaagtttgatggaacagttgtccggactaatcactattatccttatgaggtgtcatttgcagagagtacattagtagataaacattcgtaagtataacggtaaagaacttgataggaagaatggtcttgattggtatgattatggggcgcgtatgtatgatgcagcgcttggtagatggcatgcggttgatccgatgagtgagaagtattattcaattagttcgtatgtatatggattaaatacaccacataattgtattgaccccgatgggcagaagattatttttgttaatgggtatttagggtttggatctcctagaggaggtggcacttattggggaggagtaaatagttcttttgttaaaggtgcaaaaaacttttttaatgatcaaagtgcctatttcaccgactttgattttaactatttgcgtagttctacctttttaagaaatttagatggatatgcatatgctaaagaaaattacaaacaattgataatgggtatgaatccacaagaggatgtattccgaattatttctcatagtatgggaggtgctttttcagaaggtattattcgatatttaaaagagcaaggttggaatgttgatttctcaattcatctaaatacatggttgccttctgaattgatgggctcggttggaacatttttgattgatgctacgattactaatgattgggtacaaggattaagtcttccaatagatggtagcagagatattcctaatgcgaattataaaataagaaagaaaagcaatgaagggtatcaatataggcatagagattggattgatagtggaagtttttggaatgctaacaatggtataacttggaatcaacttatgccaatcttagattcatggttaatacaaaatccaaatatacaaataaattatggacaataacatattgaaaattattttcagagtagttgcagtgctactaagtttaggtgcattattttttcaattaattaattttgtttttgggactatggttaaaaatgtctcagatatgcaagatgattattggtattatggtacagaacttatacctcatttatttacgattattattattatctggtttgtagtattccctttttatgataaaaagtacaggactcttggcacagtagttaaatagagtattaaataatgtttaatggaatgctctttgtcactttttagctttctttgtcacagatcatagacggaatatatgcgacagacggttgtgctcagagaatccggaagccgcatcctagaatataaggttgttgaaatctataggagtggggaatatagttgcaacaattgtggtgatgacaggtgtccttgcatttatgcagggacattttcattgcccactattccgaaattcaactaatttgtagtatctttggcgcggattaacagcaaagcgtatgacaatcaaagaattcttttcttttaaaacaaataaatatttctgggtgaatatccttgtcatgattgtggcagtggtgctgattgtgttcggcgtgatgaaatggctggatgtttatactcgtcacggtgaggcggtggttgtgcccgatgtaaaagggatgactgtggatgaagcttcaaaaatgttccgcaatcacggattggtatgtgtcgtttccgattctaattatgtgaagaatatggcagctggcattgtacttgatgtcaacccgggaatcggacaaaaagtgaaagaaggccgcaccatttacctgactatcaatacactgagtattcctttacgtgctgttcccgatgtggcggacaacagttctctgcgccaggcacaggcgaaagtgcttgctgccggattcaagctgaccgagattcagttgatgaacggtgagaaggactgggtgtacggcattaaatatcaggggcgctcattgaatgcgggagataaagtacctttgggagctgcattgacactgatggtaggaaacggagaaaacgaaccgttggaaagcgactccatggaaaatgttgaaggggcagatgaacctgtttcctcagaatccccttcaagtcaggatgatagttggttttaattgataaataacgaaacagattcacatgatcgaggaagaacttccggatgaactggagaatgatttggatgatatagaacctgtcggtgacgaatcccagctttacgaacattttcgggtggtcgtagacaagggacaggcgatggtcagagtcgacaaatatctgttcgaacgtattgtcaatgcttcgcgcaaccgtattcagaaggctgccgaagatggattcgtcatggctaacggtaagccggtgaagagcagctacaaggttaagccgctcgatgtcattaccgtcatgatggaccgtcctcgttatgagaacgagattattcccgaaaatatcccccttaatatcgtttacgaagatccatatgtaatggtagtgaacaagcctgcgggactggtagtacatccgggacacggaaactatcacggtacgcttgtcaatgcgttggcatggcacatgaaagatattcctgaatatgatgccaatgacccgcacgtcggcctggtccaccggattgataaagatacgtccggtctgctggtgattgccaagacgccggatgccaagaccaacctcggaatacaattctttaataagacgaccaaacgcagataccgtgcccttgtctggggaaatgtggaacaggatgaaggcacgattgtaggcagtatcgcccgtaatccgaaagaccggatgcagatggcggttatgtccgacccgtcgatgggcaagcacgcggtcactcattatcgggtgcttgaacggctgggatatgtcacgctggtagagtgcatactcgaaaccggacgtactcatcagattcgtgtccacatgaaacatatcgggcatgtacttttcaatgacgaacgctatggcggtcacgaaattctgaaaggtactcactttagtaaatacaaacaatttgtaaataattgctttgacacttgtccccggcaggctctgcatgccatgacattggggttcgtacatcccgtcacaggcgaagagatgtactttacttccgaacttccggatgacatgacccggcttatcgagaagtggcgaggctatataagtaacagagaaatagaatgaaacgcacaattgctatcgtagccggaggtgacacctccgaatttcatgtatccctgcgtagtgcacagggaatatattccttcatagataaggaaaagtacacactgtacattgtcgagatgcaggggacccgttgggaagtacaattgccggatggtgcaaaagcaccggtagaccgcaatgatttcagctttatgctgggaacggaaaagatcaggtttgactttgcctatattaccattcacggtactccgggcgaagacggccgtcttcagggatactttgacatgatgcacataccatactcttgttgcggggtgctggctgcggcgatcacctatgacaagtttacctgcaaccaatacctgaaagccttcggagtgcgtattgcagaatcgttgctattgcgtcagggacaatcggtttccgacgaagatgtgatggaaaagatcggtttgccttgtttcatcaagccgagtctgggcggttcgagcttcggtgtaacaaaggttaagacgaaagaacaaatacagccggccattgttaaggcctttgaagaagcccaggaagtgctcgtagaagcattcatggaaggaacggagctaacctgcggctgctataaaaccaaagacaagaccgtcatcttcccgcctacggaagtggtgacacataatgagttctttgattatgatgcaaaatacaatggtcaggtagacgagattactcctgcacgcatctcggacgaactgacgaatcgcgtgcaaatgctgacctcggccatttatgacatattgggctgttccggtatcatccgtgtggattatattgtgactgccggcgaaaagatcaatctgctggaagtgaatacaactccggggatgaccactacaagctttattccccagcaagtgcgtgctgccggactggatataaaggatgtgatgactgatataatagaaaataaattttaggtattaagtattaggtaataagtattaattccatgcggtttacagcgcagcctaatacttaatacctaatacttatttataaacttcatagcttatggatactacagagtttgatgagattcgtccttacaatgaaactacattgggattcgtatccgcttgtgcattaataatagggagtaaagcccccaaccaaggtaaatgtttttttatattcataattattccgatttaattaacaccattctcattgcttccaaacaaaaataaggaagatatcatagaaaaaaggcaaaattctgaccaataaaaagcaatatctaataaataatcgattttctttcacaaaagaataaagatagagaagaactccggtcatatgttcttctctatctcttatatttgataatttatccaatattaatcaatagacaaaactatttaattcccagcctcccagtcaatagcttgatcttcatctggtatttgagtattgatctgacgctctaaagccaaagaacctattacatgatattcggtttctacccccggaattgtagtatagtcaacataagtgtaattaatatttctaatgattatagtcttacgtttcaaataaggacgaataggatccattgtttcagttacactataggtaggggttacctctttcccatagtcatctttacctatttgaaatttcattttattgtcagaatctgcaggagataattccacattgccgatttctccattatcattatttataaatttagcaagaatcctatatcctttcctatcgacacgggtttcatcaataatgccagcatagaaaaaaaggctttgatcgtccaccacataagtcattacatagtttttgacaaatggggcctcactttccgctcctttgatataacacttataatttactgcactataattgcccgaataatcattaaaaggcataacacggagtaatgctttgcgataatgcttacgataattaggggtatagctaccatctgaagattcttcaacagttaaaggcagcacccatttctctgacaaatcaatattattcaacttaaaatctataggtaaaagtgctgtattctcccctgcttttatttcaacggtctccggcaatgaatagaaagtagctggtaatacctgataataaagatctatacgcgtactataacgttctttattaagaaccactaaagtatctgggtccaaaccaatacgtactgtatagtttttatcatttaaagtcgtaccgctaactatcaaaggcacctgataagtagttgcttcgttcgccttatagcgtacgttaattcgtgataccccatcactgtttattggagctttaaaagaaatataatgttcatattgttcaccactccactcttcattacaggagataattaatgcgctaacagttagcatcatcaaataagtatatatctttttcatatcttttcttttttaattaatcattataagtccaaccaggattctgagttaaacgtttgttgcgtttcaattcatcatgttttataggccagaaatacattttggatgaaaaagttgctgaaagattagatatgggtaccggtgtatggaaaagatctttctgactttcagtcataaaagtataacaaccataaacaggcactgactcttccaattctgcatctttccaacgacgaagatcatagtaacgtttcccttcagcaaagagctcaatctgtcgttcacgtttcagtttaatacggaattttgcagggttatcatatataggagtatcataatccggtacaccggcacgcatacgcacaggttttattccttttctcatttcttccggatcacggttaatggtataagctttaattccgtcccatgaggaaacctcataagatgtagtcaattcgtttaatgcctctgcatacatcaacagaatatcggcataacgaatagctggttcatctttatcaataattttggctccgtcgctattttcataagtatcgcttgggttcacgtatttcatcactccaatacctgtacgcagccaaaacatattattggaataaccattacctccacctcgatagtagaatacttgtttattctgatttgcttgctgagattcatttcctaaataccatctggcaccgttaaaagcaacagaagcataaaaacgtggttcccgatttgcatattgcaaagaaacatttgcagaaagcggtttatagtcctgtgcgtttgaagtatagccgactggtcgcgggcgattgtctacacgatccttatatgcttggtatcctgcgtactgagaattcattccaggacaatcgtctccagtattcatataataagcatctacttgtttttgagtcattccatgggtattccatcctttagcaacggaaggcagttggtgaattaccatatccttaatgcgttcaccaccgatgttctgccctctagtaaaaatcagttcaggattatctactgatgacacagttccattaaacaatgcacgatatgattcgtatggatcaatattcgcccatccattcggaaaatcttcatttgaatatacatcgtgatgtggaggcgctatagttgccggaaaagcacctgtattcacggtattgatacctgtggtataaagcttatatacattcaattccattacatctttgcaggcagcagctgcttttgcccatttactttcatcatattcaggagaaagcaaacgattacctttatcatccagcaattgttgtgcatattcatcattattaccattcgttaacggactggcagcatacaatagagctaatgcacgggtagccaaagccgctccccgcgtcggacggtttatactaagttgctctctcgtcaatggcaaatctttagctgctattaccatttcacttgcaatataattggcacaaacatcataagaactgcgtggtgtagcgacatcatcataagagtcattgtagttaaaaccattttccggaactagaggtatcggcccatatttacgaagaagaatccaataaaaataagctctaacaaaacgcgcttgcgctttaagatcaacaatctcttcaggtttatatttatcgttcatatccacattctgcatgaaaatcgtagcctgacgaataccattataacagcgatcccaagtatcctggaaagcaccttcgtcataccctccttcatgaaacttattatatgacatgtttccacctttggatgcgtctatggtaacatcatcatcaccatagtacatacagtcgtcaaacacaaacggagtattgcgtttactgcctacatcgcagcattgcccggtaaggaatgaatatgcacgtgccaaccactgttcggtcttatcataatctgtaaatatcttctccaaagattcacgatctttaaaaatgtattctgaatccaaatagtcagaacctgataagactcatctgagagacctctttgataaaactaaatttcaaaatgacaaagaacgattcggaccaaatgggccaagtttatttaatttttaattcgtcccaattttaatgggacactaatgtaataatacaataacttagattttgcgtaatatatcaaccaattttattttcttatctttatttaaacccatcttctccaatacagaccaacttcttttatatacggcagcagaagtgcatccccaaagactggcaatatcggcatatttaaaatccaacctaactaaacagcaaaaacgaatatcttcctccaataaatactcatatttagtgcttaatctttctacaaatcccaaagatgccatatctatttcatgcaataaaatatcccattcatcattagtaatcttcttcattccatcaggattaagtttattatactcacacaattctatcaacatttgataaacaggagaagacattaatataaatttcagattcagatttctcaattgctttacttcctcatctctttctacaagccgacgttctaaatcttcttgcattaaatggtattgttccaatagttcattaagacaactatctaattgtgctttggagttaacatctgactctaaatattcacaatgttgctgtatttcttttatttctatattttttttctctaactctttcttgatagtctctatacttttatacaataattgtcgtttattgactaattgtgccatttcttccttcctttttctacgcctttgcaaaaagaaacaaatcgtaataataaacaataggacaagtaacaatagacaaaaacgatactgagtcaaaaatgattcatagcgttccgttgattgatgatataacacatccttcaaagaagaaactacctcaaccggttgctcgaccaatttcatggaatccttatatatagcatataaagtttcgtattccaatgcttcattttttttccccaacttcgttgccatttctgataatttcatatatgcatttgtttttgcataataattatcagaagatatacctctattcaaataaacagaggctgaatcatattgttccaattgcaaataagcactcccaataactagatagtaaccatatctttcagaactgtctaacaccaatcgcatacctttatttgcaaacaatatagcttcgcgtgatttcccttgatattctagaagataactaagagaactaaacacaagctccttaatatgttgtttatctgtatcttttattagctttagggctcgttttaaatatttttctgcatctgtataatattcttctcctcgctccatgcaaatatctgcacaacttactagcactacggctaaacgcaatgaatcatgatgtgtttctgccaattcaatagtctgtctataaagagaatcagcctcttcctgcaatccatgctgccaaaacaataaacccaaattacttttcaatagaatattcaaatcataattatccactttctcagctaaaggcattgccaccaaaaattcacgtacagttccttcaatatcacctctgtcttgacaaactcgtccaagataataatgagcttttgcccgtagggtaatatcatcggaagtatcataataatctacagcgacacgaattaacgaatcatccgtatgagtaatatagttcttatctttggcttgtgttaacaatagggcatacttagctctagactgtatagtagacaactctgcaagattcacaccttccaatatactcaatgcactatctgcacatccaacttctatcaaagaatctgcatgcaataaagaaggaattaccctatctgtgggagaaaggcaagatgttaaaaacaggaagatgattccatagacatagtttacattcatcacttttaatagatttcgaataagttttgtttgagagcagaagcaaaagtaaaagaattataatatatttgcaacttaaacctaaaaatgtttaaccaagaatggcagaatctacgattattaccggtcagtttgttcgaatcagccaaacgcccgccagtatcggcgaacgattgctggctttggccatcgattattccctgattgtgatttatctatattctgtgacgacactcattgttaaactgcatttatcctccggagtcggtacggtctttattctgtgcctcgtctatttgcctgtacttctttactcgttcctctgcgaaatgttcaaccacgggcagagttttggaaaacgtctgatgaatatacgcgtcgtaaaatcagacggttctactcccagcatcagtgcttatctgctgcgctggcttctcttcatcattgacggtcccggcacgggaggtttaggacttttagtcgttctgctgactaaaaacagtcagcggctgggtgatttagcagccggaacgatggtgatcaaagaaaagaattatcgcaagatacacgtcagccttgatgaatttgattacctgaccaagaattatcatccgacgtatccacaatctgccgatttatcattggaacaggtgaacgtaatcacccgaacgctggaatccggtgaaaaggatcgggtaaggcgcgttacgttactcgccaaaaaggtgcaggaaatcttatctgttactccacgagagaataatcaggagaagtttcttcaaacggtacttcgggattatcagtattatgcgttggaggaaatctaaaataagaactcacacaacacgtatatacactaccgtcttcccatttccatatttctgaataattcctttttctatgaaaagattcaattgatgcaaagcctgtaatctactcatcccggtaatagcacaataatctgcccgattgatacaaggatgtttctctaaaaagtcctgcaattttttcaagcactcgtcttcggatattttcgcattggaacgtgtcggggaagatattcgttctagatccattttagagttcagttctctcttatatgtttgttttaccttcagcttaatatttttcaggcgaatagatggagagcgtacttcttttctgtcaataatctctttttccaaagaaagggtcaaagaaaaatgccctaaatctccaaattccacaatatatcctctggacagcagtgtctgtaactcatcggtgatagcctctaccgctccaactaattgcgcatggggaatatgatgcatcatggacacccgctccacaaattctttggttgtatatgttccgcttggcactacccgtgcgtgtagcaacttctgttcttcagcatcctcttgtttgggattttcataaaggtcgtaataaatgctcataagaataattttatgtttggctgttaataacttaatggtttctatttaagtaattagttgtttgttggctacattctttcgtattacttaagtgagacgaatagattacttaagtaagacaattatatcacttaagtaatttgattatcttacttaagtgatacgcaataaaacaacgaacaaagatactaaaaaagataaatagagtatggatggggtaattacaaaacaatcagaagaatatattatgataatggggatgcttagaaaatgctcaaaggaaattcttgaatttcagaatttgcaggttcctgtagctaatgaggtttatatgactggtgagcaggtatgtagtatgttacatatatcaagcaggactttgcaaaagttgcgggatgaaaaggggatagcttatactgttataggtggcaagttcctttatcctctttccaaattgcaatcagtattggaaaaaaattatagaagttatcttcgttaaatcaagtgatgaatttgtatttatatttatattgctttttcgtatatttgcaaaagtaagtaaaagtataacaggaagaaagttgcagcatatatgcggtgtcataggagttgaggcttcaagtaagattcagataatgagtaaggaactttagagttaaggatgtgtaaattaaactgtgtcatgctctattctcattcaatctcatcggtctaggaacggcccggcgccaatgggcgggactaaccgtcccgacgagcgtaaaattacaagaatttaaacttatctccaaattttatcgccagttgttgagtaatggcttcccagttagccagtggcatagtccatttcttacgtatgttgcgataagcgaggtaaaccagtttttcaagggtggtgtcgttagggaacacacccttgttttttgtcactttccgtatctgacgatgatagccttcaattgtatttgtggtataaatcatacggcgtatatctgatgtgaactggaagtattcagtaagtttttcccagttgtcctgccatgacttgatgacgataggatatttttcttcccatttctcattcagattaaaaaaactctgtttcagtagcttatttatgtactgcaccataaacccgtttcaagtttttgaggaattccttctgatgcttactaccgacatatttaatggagttccgtatctggtagacgatacaaagttgtaatattgtgttcggaaaaacactttgggtggcatccagcctttcaggccatcaacgtacgcaataaggatatcatgaactccacggttctgcaaatccgtcagtacgtttaaccagaaatttgctccctcatttttagagatatacattccaagcaaatccttgtggccttccttgtctatgcctaagacgttgtagattgcgcgggtaacggtacaccctctctcgtcagtgactttataatggatagcgtttatccagactatcgaataaacatcatcaaggatacgggaacgccaaacctttatttcaggaagaacacgatcggttattgaactaatcgtttcgtcagaaacacggttgccgagattttcctttagccagtcactgatctcacgtgtgctgttaccaagggaataaagtccgatgatacggtctgctaccccctccgccaagatggcctcacgcttctttatatactaaggctcaaaacctgaattacggtcacgaggggtagacacagtgatctcacctaatggagtctggacttgcttctgcattttactattacgacgattacccaactgacgtttttcttctgtaagatgcgcatccatttcaccttccaatgctgcattcaatatactttccaataaggggacaaaagcaccatccttaccaacaaaggcttatcggttttcagctgttcaatagctttgttcttaatattttcaaaatcaaattctgctttcataaaaaaacagtgttagcaaagttaattccttgatgacacagtttaatttacattctctaaagttaattgttccctgtctttccagctttcagtagttttgtacacatctttttgatattaaaagttatagcaaagaatgcaaagtccattgtaaccttttcttctcccacatgccggaccttctgtatgccatgttgtgtttcatttgtccaaaaactgcttccggttctatacatcgccttcccctatgcctgatgccttcttccgagccgtaaccggagtctgccactccgacagttggtaagtggttatagcgttgctcaaaggagtggaagaaaggtatgagggtcagtgtatcggttgggttgggaaacagccggaagtctatgaggaattggttctcggtacctatttgcagattatatccgggcttggtctgtccgtttttcatggtgtcttctttcatgtgcatgaaggtggcatcaggatcggtcttggaataggagttgcgttctccaagagtatcaagatggttgtcgtattccatcaacttgtcacggtactcctcaagttccggacctgtttcttcttttctcgtatgactttcttttgttccttgtcctagtgttccagcgcctctttaagttcattcactatatctgagagcatggcaggagtgaactctacggatgtgcctttggaggagttctcttgggctatggcttcatctgcctactccaggagaatgcggatcttatccatcagctttgtacggttcttttcgactgtcttgcgccagacaaaagtatatttgttggccctgaactcaatcttgctaccgtagatatgctctacgtcaaggctgataaaacctttgtcggcaaggacaaggaccaactgcgtaaatacggtatttatttcttcttttgcacggtttcgaaaacggttgatggtagtaaaatccggatgttcattagcggaaagccagatataatggatgtcacataggagaagcttctctattttgcggcacgaatagatattgttcatgtaggagtaaataatcaccttaagcatcattttaggatgataaggacaacgaccggttgctttataaagcttcttgaaattgtcaagattgagattatcaacaacagtattaactatgcgaaccggatcgttcgatgctatgttttcatcaattctttgtggaaaaagaacggtctggttggggaatgtaaggacgaaaatgtaactttgccataacaaaaaactttatgtctaaagatatagaaactttggataataacaaagcccgggcttgcgaagtctgggctttgcgcataaaaaagggtgtgccaacgttgaagtgcacctcaaaagttagataaaaaacttttggggtcatttcacatttgacacaatctctttcttttcaactttcttatacttttatgaccaaagagaaagaaaaagattatgtgcgtttgaatatgttaaaatatgacccgatttgtcacgtttaggtggtatttcttttttgtcgaactaggaattttgtttttgcgacctacagattttccatttcctgttttcagactgcaaatttacgaataatccatatttttatttctatatatgtaataataacaaattaaagaatttaataattccttaatattcccgaaagaaatgtgaaataaaatatatggaattttgcagcgagaaaaaatagtaagtatgcttaaacgaataattattgcattgaccattgcttgtttcgcactggcagaaacgaaagctactcccaaatatatcttcttatttataggagacagtatggggcatatattctctgatgcctacaaggctaataatctaaaacagatgaaagcccaataaatttctcatatgtaattctgataaattaaatttgttacattatgaacataaaaagccaacaggcaaaaaatagttttttattcatatttatatatctatgtagtctgtctttgcaaccagctttcgcaactcaatcgaaagaagttataacaacagatatctgggcagccactgccactgtattcaaacttgtcggtgaaaaagctgtcaacaatgtaaaactgaattggatgcaacgagaggacgctgacctttatagaatctaccgggatggaaattgtattggagaagctaaaggaaatacatacgatgattataatctgaaagcagataaaacttttacctaccatgtagaagcatttaaagaggggaagaaaatagccacgtccgcttctcaacaagcaacaaccttcacccctaacggcgaaactaaagtttatgataatctaaacggaaaatatatcaccaaagaatctgcccaaaaacctcagggtatgaaaattggggagctttatttctcttataaaatggaaaacgttgaaaaggaagtagatggacaaacactcaaaggatggctagctacagaaagcttttctccgacagggctcaatggtagttggagtacttcccgtgaactggctttttacccaaatgtaaaatttgagggtattgctttccgatataacgcaaaaaccggtaaggtagtactttcagcacattatgaagatcaaagtggatatgttgcagctaaaatctatctggcacaaataactcccaaaggcgagctcgaagtaggcactatggaacgaccattgggctatgactctagagatcaatctcttttcattgatgatgacggtacagcttatctcctttcagctacaaatatgaacagagatataaacatctataagctagacccttcatggactaagcctgttttattagttaatacaatatgtaaaggactacatcgggaaactcctgcaatcatcaaaaaagacggagaatattatttcttcagttcaaaggcttccggatggtatccgagtcaaaccatgtatacatctgccgctgatttaggaggcgaatggacacctatgagagaaattggcaataattctacttttgatgcacagtttaacagaatcagtacagttggaaaaacctgcggagtatggagttaccactggggagcgcaacgaaaatataaaactccggctggcaatttcccgagaatttcaatagccgcatttaacaaaggatatgcttcgatggattattacagatacctggaatttagtgacaaatatggtattatccctgttcagaacggtaaaaacctgacattaaatgtaccggtgacagccgctgtcccaggagcgagaggaattaaagctgattgtatcacggatggagcttgtactgaatcttctacttatttccagaaaagttcaaatgctgctacaggttctccttatatgtttaccatagatatgcagaaagaagccgtgatttctgagattaatctttcgacaagattggttaacggttccgaggctgcctacaaatataccattgaaggaagccgggatggaaaaagttataaaatgctcgtagacggcaaattaaactggcaggtaggatttctaattctgaatattgaagatccgtcgctctacagatatttacggctccgcgtatacggtgttgtcaatgtacataaaaacaattctgcaatgtgggcagatggcatttatgaatttgctgcttacggaaaaccacaataaataagaaagcaaagtgtattagaaaaagccagttaactatttaaatgttgactggcttttcattttgcatcgatcacaaaaagttaccctattaagctttctgtatttaacgattccattattcgttaatatataccattttgtacaagcaaataataaactaaagcccaatcctgatcatttgcatatggatcgtagaatccgccctttactccgttaaccttatttggataaatataggcgcaagaagcttttccatcttcaaagaataaacacagattatttctcacaatattctctgcacgctctttatatgaatgatctcccgtacattgcgaataaagataaaaagcagctcctgacaatgtactccaatagtgtggaaaagtatctccccacatttcccgcttaccaaaccaataaccatcccaatgacgaacagctatttcattcaaatgataactgggttgtttgccattgaaagcttccaatacaggcatttgaatctttgccccatccaaatatttctgccttccggtttccatataaagttgaagcaagaacatgactgatggagctacaatggcttgttcgtagtttacttcactagccggataattcaaaccatttttcaaaaaagtatcaccaaccgcaatataatcattctccaactcttgatattctctttgcatatcagcattttttaaagtttgcagtcctaagcgaaccggtatacctatggcataaaaaccatgtccgaactgtttgaacatagaccgcaaagtcatataaccatgtttagcatattgtttgtcattggttattttatacatctggaaataaaaatccgctacccatacataattgtacgccctgttacgtcccttctgatcgactgaagagaaagtcttatagtcagcatcttgcaatctattacgcaaaaaacttgcatatcgcaataaagatgcctttacttcagcaacaggatgcaattgataatactttgctaaaagtacccccataccgactctttcagcaccttcatccctgtcaaccggattacagttatgcgtattattcagatatatttcattcttttcattatcataaaccatataagcatctctacgcgtattcgaacttttcatctgttgatttgcaactataaactctactcgttttttaatcaaatcatccacactactaatcaccaaacaatttgcatgagtttttttccctgtgccatatagtatatcaaaacgcacttctcctaactgatccattactacttcagcataccatgctgttccttgttttttcataggaatagtgacatcattctttttaagcatacagccttttaccatctgcccacctgatattttcacaagggcagtttctcctttctcaaatacatacttgttgcaagatacccaaacactctctctttccaataacttttgacgaaaatcatcttcacctttatgcgaaaagatataccacgaaaatacttgttcatcacccggcatcaatttcatatccggaagattcaaagaaataattccccttgtatgagagttacccttatttctatcacgctctgatatttcataacttttaatttcgccttccctcaaaaccagtcccaaatgtggagcatatcccccatacgtatcgcgtttacataagctgcattatcaccctcccatatatgagcattagcccgcatatttatacaagtttgtgcccctggatagttatcattgaatggagtatagatgcctatatccgataaaagtatttcctctgttccatcattttggaaagtatactcttctattaaatcttctcctctcatactcctttctacaaggatacatatatctccaactcgataagtaacttctctcccatcctgctttatactggcaggaagattccaaaacaacttgtttttctgatttcttctcacctcagtgaaatagccaagtccccaaccataattctcctttatccaaggatattggctaccatctgttgctatcagccaattcatattctgtttatcattatcaatattcattgattgtatggctccagttttcgaattcactgtaaagtttactttttgggctttaacagaaatacatattactgtcaacaacccaataccacaaagctttaaaaaaggattctttacttttcccattgacatcatcctatttttcttaaaacagggcttacttcttttagataaatctaaatcaattcgggataaagaaatatccgttcactgcggggaataaggcaatcagcatatacggagaaatacctaacgcgatgcccagcggcatcaatgcccgcaccgtggccgcctggctatacaacaggatagacatgacgaacagcgcaataccgaacagccatggcatctgccgcacgattccttcgatggaaagagtgagctgtgccatattgccctgaaggaaagtatcacccatccacgcaataccgaagatggcgataacagcctgcatcccggcagggaatacagaaccctgcgttgctttgattccatccgtcttggttactataaggatgatagcggctgccgacaacattacgatctcgataatggaggacataccgagcgtgacgatttctccatcgatgaggaaactgggacgcataccttcaaaagatccgaaaaggacgataaaagcagttgccaatataaagatgagtacggaaagcatggcggaacgtttgttcttgacatctttaatctctatcttcttgtcattgaaaagaccttctttcaagcgtttctgatattcgggatcctctatcagttccttgccgactttcatggagaataaagcgccgaccaatactccgatgatagtggcgggaatcgtaattttaagaatatcgaataatgtaatgtcgaaacctgccagtaacccgagcaaagctaccgttgcagcagagatgggactggctgtaatagcctgttgcgaagcaatcacagcaatacccagcggacgttccggacgaatctttgtttcggtagctacctcagcaatcacgggcaatacggaataagctacatgcccggttccggcaataaaggtgaacagataagtcaccaatgggctgagcaacgtgacgtgcgaaggatttttgcgtagcaaatgttctgccagtttcaccatatagtccagtccgccggctgcttgcatacaggaggcagcggaaataacggcggcaatcatcaacataacgtcgataggtggtgcggtgggttgtaaaccaaaaacaaacgtgagtattcccaatcctactcctcccatgacaccgagtccgatgcctcccaaacgtgcgccaataataatggctgtcagaacaaatgctaattgtaatatcattggttgttgttttataagttcctaacaaagataaaggatttatcttcgttttttctctgtttctaagataaacaacaaaaaagttattgaatagtttttgcatatttattaaaacaataacatctctgactggttattatatcaactaacgaatgtgttattgttataaaacaaccgatatggaacagaaattatcaaaaaaaactcgtacagagagcgacttgataggtagtcgtgaagtgccggaaagtgcattgtatggagtacagacactccgtggtattgaaaactttcgcatcagcaagtttcatttgaatgagtatcccctgtttattcaggcattggccatcactaaaatgggagctgccgttgccaaccgtgaactggatttattgactgaggaacagacggatgccatactgaaggcttgtaaagaaatactggaaggaaaacatcatgaccaattccctgtagatatgatacagggtggagccggaaccaccaccaatatgaatgccaatgaagtgattgccaaccgtgcactggaactgatgggacatgcacgcggagagtatcactactgctcgcctaacgatcacgtcaatcgttcgcaatctaccaatgatgcgtatcctacagccattcacattggtctgtattatacccatcttaaattggtgaaacactttgcaacactgatcgaggctttccgaaagaaaggagcggagtttgcacacatcatcaagatgggacgtacccaactggaagatgccgtaccgatgacactaggacaaacctttaatggattcgcaagtattttggaacatgaactgaagaatctcgattttgccgcacaggattttctgacggtcaacatgggtgcgacagccatcggaaccggaattaccgccgaaccggaatatgcggaaaagtgcattgctgccctgcgcaagattacaggactggatatcaaactggcagatgacctgataggcgctacttcggatacttcctgcatggtaggatattcttcggccatgcggcgtgtagctgtcaagatgaacaagatttgtaatgatctgaggctattggcttccggtcctcgttgcggactgggagaaatcaatctgcctgccatgcagccgggctcttccattatgccgggaaaggtgaatcctgtcattccggaagtcatgaatcaggtctcttataaagtgataggaaacgacctttgtgtggctatgagtggagaggctgcgcagatggaactgaatgcgatggaacctgtcatggcacaatgctgttttgaatctgcggatttgttgatgaacggttttgatacattgcgtaccttatgtattgatggtatcacagccaatgaagaaaaatgccgtcgggatgtacacaacagtatcggagtagtgaccgcactgaatcccgtaattggctataaacattctacaaagatagcgaaggaggctctggaaacgggtaaaggagtgtatgagctggtgctggaacataacattctttccaaagaagacctggatacgatcttgaaaccggaaaatatgattaaaccggtgaaactggatattcatccgaatcattgattcataggggtaaaatgagaggccagcctgttgatataggctggtctctgtgttttgtatcattagtgtattttatgtatttaatcttggattctttttcatttactcgtaaaaaaaacgaaataaataaaggaaataaattgataatgtctgttttttagtatattcgtaaaaagtagtgtacatacaaagcaaaactaaaagaatacaaattaaaaacagcgattatgaaaaacaaaccttttgagaattttgactttatagacttctgggatgatgatgaatatgctatgaatgaatatattggcgcacctcctacagaagagatgatagaagaaacagaacgtgaactgggatacaaactccccgaatcttatatttggctgatgaagcagcataacggtggaatacctttcaatgtttgttttccttgcgacgaacctaccagttgggcggacgaccatgtggctatcactggcattatgggagtcgataaggataagatttattctctttgcggacagctcggcagccgtttcatgattgaagaatgggggtatccggacattggagtggctatctgcgactgtccttctgtgggacatgatatgattttccttgattatcgggagtgtggtccacagggcgaaccgaaagtcgttcatgtcgatcaggaagatgattattatgttactttccttgccgataactttgaagaatttattcggggacttgtcaacgaagaagtctttgatacgtcggaagaagatgaaagaatggagctggaaaaagttcggaacgcagctttctcaccgctcttgtccgatttgtgcgcaaagtgtgatcatcccgtggatacggagcgatggattcggaagatatcggaagagatagtaaccgataaaggattctttgcgcttcatgccgacgaacgttcttatctgctttacgacatccagttgtggctttacaccaacgtttatcccgatacgacggaagaagattacctgtctgcttataaaaagataatagcgctggacggtgagttcagtacgggaggatatgcttcggactttgttaccgattggctgacacgacgcaaggagagcggtatggttacgtgtaatgacggtattctttcgatggcagcgggaactaaggaggccttgctggcaaatcgggagttgatttcgaacaaagagcaataatttgtgtttatttattataaatatatatctttgtcccgaattataaacacgtagatttatgaaaaagatttttggtgctttaatgattgccgtatgtatcggtatggcgatgcctgcccaggcacaattacattttggtgtaatatctaatttttcgcgcgaatatgattttgtatgtattgtttggtagatagggagaagagttgatacataaataaggaattggcaggtattagtttttttataaaactcttcttccacttttcttcgctgaagtatataatccttaaataatacgatttatgaacaaattccttttataaggatcatgatataaatgtttaaccaaaataataaagaaaatgaaaaacagttttttgtgtgtcggctcttttctattggctgctagtttttttactagttgtacagaagacaaggattggtccggtggattgaagaattctgatctggtattccagacttatttgccaacagaaggtgccaaaggaacggaactttctattcgaggcaataattttggagaggatatcagccaagtccaagtatgggtgaatgaaaaagaagcagaggtgatttcggttacttctacccgtattatggctagggtggctgaagctagtggtagtggcgtagtgaaagtcagagttggggaagtagtatacagttatcctgatttattttcctatggttatattcgcaatgtgtacactgtagctggtaatggtcaaggtaccacagttgatggtgcatatcttcaggcttctgtccaatggcctattgtgatggtttatgataaatgggatgatgccatattgttcttgcaagatgaaggagaacaccgcatccgtcgtatgaaagatggtaaaattgagactttatgttccacaaaaagcttagtgaacaatgcacgcagtatatgcttctctcttgatggagatacattgtttataggcaatgataatgcgaataactatgtggcaaatcctgttgcagtcggaatggtaactcgtaaaggtggtttcaaagatcttaagtcatatattccttctgagaaattagctcagccccatattaatggtatcgctgttaatcctgtagacggttcgctttttacttatcattggggacgccatgtgtttcgctataataaagctactgagacttgtgaatatgtgattacacgagatcagttcaatgaattagtagttggtttgttcccggatgctgacggaaatatgcaaaatataggtggtgacggtggatatggtggacttgctttctctccggatggaaagactctttattggaatggacgtgatccatatcagggtatattaaaagctgattatgatcttgtcactaaaaaatgtactaatctaacccgctttgcaggtaatggagtctgggggattattgatggtcaaggtgtttcttcacgtatggaccagcctaatcaaatagcagtggatgcggaaggcaatttgttagtaacaacagtttatgggcgcactgttcgcaagattactcctgaaggatatgtgagtacatatgctggaataggctaccagacgggatatgtcgatgggcttgctgcagaagcgaaattcaacaaaccttatggtattgctattgatgcccaaggtaatgtatatgtaggtgattgtgagaattggcgtattcgggtaatcaaagaagaatgattgttagaactaataactggtatagaaaattaaagagtatattttatgttcaagaaagaaatatatagtctattgctattctcctttgggcttttgtttacttgttgtggagagagtgcaacagatgacgaggaaaaagataataatggtcagggaagtgttagtgtggagactaattacctgcctattgcagacccctacgtgatgttctataataataaatattatgcttatggtacaggaggaacaactgccggagaggggtttgcctgcttttcttctgacgatttgaaaaactggaaacgtgaggggcaggctctatctgcaaccgattcttatggtacatggggtttttgggcaccggaggtctattacgttgagtctaagaagaaattttatctgttctattcagcagaagaacatatttgcgtagcgacttctactactcctgaaggtccattccgacaagaagtaaagcagccgatctggagtgagaaaagcattgatacttctttgtttatagatgatgacggtactccatatctttatttcgtacgttttacagatgggaatgtgatatgggtggctcagatgactgatgacttgatgagtataaagacagagactttgaatcaatgtataaaagctgaagtatcatgggaacttttgcaaggtaaagtagcggaaggaccttctcttttgaaaaagaatggcgtgtattatctgatttattctgctaatcattatgaaaataaaggatatggagttggatatgcaacctcagatactcctatggggccttgggtgaagtatagcaagaatccacttttacagggtgatgcagctaccggcttagtaggtacaggacatggagcgccgttccaatgcaaagatggtagttggaagtatatatttcatgctcattggagtgctgcggagatacaacctcgaacatcgtatattaaggattttgccatttcggatcagggagtggttactattagtggaactgtaattaagccgagagttctgaagtaaaaggataccggataaatgaatatcatttttaatttaaaactaatactataatgaataaaaataatcgaatgagcaagaggcttttgaactatgtcattgtccttttggtgtgcttgattagtagtgcggaatcttttgcacaaggcacaaagtttcaggtcaagggaaatgtgacggacgcttcgagagaaccgattgttggtgctacaatcaaggtgaaaggtacttcgcaaggagttataaccaatattgatggtgaatactctatcgatactcgtagcaacgcaattttggagttcagttatatcggatatgtgtcacaagaagtccctgtaagtggaagtaaaattataaatgtgactcttcaggaagaggtcagtaaattggacgaagtggtggtggtaggttatggaacgcagaaaaaaatcagtgtgaccggttctgtgtccaatgtctctaccaaagaaatagccaaaatagctactccatcattaagcaatactttaggcggacaaattccgggtattgtgactcgtcaggctacaggcgaaccgggatatgatcaagcgagcatttatatccgaggttttggaacatggacaaatcgtagcccgttgatattggtagatggtattgagcgtgatatgaatacgattaatactgaagaagtagaaagcatttctgtcttgaaagatgcttccgctacggcagtatatggtgtacgtggtgctaatggcgttatcttgataactactaagcgtggtcaactgggaaaaccgaaagtgacattgcgctcagaatatgcagtgcttaccggacttcgttatccggagtatattaatgcggcggaatatgccggtttaatgaatgaggcacgtgacaatgcaggcgttgctaatatggcttatacggatgaagaaattgaattgttcagaaacggtagtagcccttatctttatcctaatgtgaactgggtggacgaagttcttaagaagaatacaacacagagcattacaaatttaaatattaccggtggtaccgaagtagtacgctattttgtaaatgtgggttatacaacgcagagcgggctttatcgcgataatggcgataatgcatatagtacaaacagtcgtgtaaaccgttataattatcgttcgcgtgtagatgtaaatctcacgaaagatctttcagtagaattaggggttggcggtattattcagaatcgtaatttcccaggaaagagtcaatatgatatcttttatgcgattcgtaatacttctcctttagcatttcctgtaaagaatccggatggtacaccaggtgcttcaccgacttatcttggtaataatccatggggtatgactacacagagtggttatgaaacacaaaactggaatacattgcaagggactttttctgcacgttgggatttatcttcacttgtgacggaagggctttcagtaagcggacggtttgcttacgatcattattattctaataataaacaatattataaggattttgaagtaaaacagtatatgggagaagacgcggagggcaatgccatctataatataccagtttacccttttttgttgtattccaattattaaatgaaaataagcaaatacggtatctagtatgttttttagggattattgttgtaatagcaattgtactatcatattcaagagctggaattattagtgttgcaatagtaattgcgatatttttgtttcaaaagcttaaacagaaaagaatttggaagtatctattattatgtagcagtctgatattattgttgtttggttgctattggatgaagaaaaactcagccgatggtagactgctgatttggcaatgtggtataaatatggtaaaagatgctccttggataggtcatgggttgggtagtttcgaagcgcactatatggattatcaggcaaatttctttaagcaatgcggacaaagccgtttttctatgttggcagataatgtgaaacaaccatttaatgaatatcttggacttcttttaaattttgggattattggtttattagtattgttgttattgatggtaataattatatattgctataggaagaatccaagtgtagaaaagcaaatagccttttattctttgtcttcaataggaatattctcgttcttttcttatccatttgcatatcctttcgtttgggttgtgacatttttaagcatattcataataactagtgaatatatcaaacctttattttctaatatcctaataaagaaaatagcttgtatgttcatacttacatattctcttttcgggagtagtaaattgttcgaacgtattcaagcagaattagactggggaaaagcttctacgctagcgttatgtaagtcatataatgaaactcttccaacctatgagagattagaaaagatgtttgtgagtaatccctattttctctataattatgctgctgttcttcaagaaatgaagcaatataccgaaagtctagaagtggctttaaaatgtcgtcaatattgggcagattatgatttagagttaataattggggaaaattaccagcagcttaacaaacctgaactggcggaaaaatattataatagtgcatctatgatgtgcccttcgcgctttctacctctttataaactattccatttatacaaaacgaatggtgaaaaagaacgatcgcttgctatggctgaggccgttattagcaaaccgatgaaaattaagacaactactattaggatgatgaaaagagaaatggaaagagaaatacaaaaaatgaatatgtctataaaactagaatgaatatggaattaatacggttgttgtcaatcacttcgcttgtgcatttaggaatctacggattgtttattgtgtgataatagaaataaatatagtaaccgaatgagaatttataaaacactaatgaataaaacattcatttatctgctaatagcagtattggcagcttgcaaaagtactccttactctgatgaaactactaaaagtgaccttcgtgcgcctgcttatccgttattaactttgcatccgcatgtgaaactttggtctatgacggatgaactgaacaaacagaatatgacttttggcggcagcacacaacttccttttgttggcttcttacgggtagacggtgctatgtaccgttttatgggtagtaaagaactgccgatgcaagctatcgctccgatggcgcttgaccatgaaaagtgggaaggaaagttcacttcattagttcctgatgaaggatgggagcaaccggattttgatgacaagtactggcaattgtcagaaggggcatttggcacgcctggcatgtgggaagcaagaacacaatggacttcttctaatatttgggtacgaagagaggttgaagttgatccgtatcttctggagcataaaaagatttatttgcgctattctcatgacgatgtatttcaattgtacatcaatgggaagcaattggtgaataccggatatgactggggagcaaactttaaagtggaagtcccggactcaattctgcaaacaatgaaaagtggaaaagcgttgattgccgctcattgtgagaatcgtgtgggaggaggattggtagacttcggactctttgccgaggaaccgactatgccggtggaaaaggtagcccccatctcttatgaaaaagagtggacgggaagatatactatggagcaacctcaggaaaattgggaagccaaagagtttgacgatacaacatggacagaaggacaggcggccttcggcacggatgatcaacgaaatgtgcatactccctggttctcacctaatatatgggtgaggcgcgaactgacattcgacccggcgttggtgaaaaacaagcaactgtatttacgctattcccatgatgatgtatttcaattgtatgtgaatggaatgcaactggtcagcacgggatatgagtggaaaagtgatctcagagtaaatatcccggattctattgcagaaactatgaaagatgggaaagccgtgattgccgctcattgtgagaatcgtatgggaggtgcattggttgacttcggactatatgcagaattgagggaagctgaacaaacgtctgtcgatgtgcaagcaacccaaacacattataccttcgaatgtggagatgtagaactgaaacttagctttaccgctccttatctgttggacgatctggagacacttgcccgtccggtcaattatatctcttatcaggctaaagcattggatggcaaagaacatgatgttgctgtttattttgaaatagacccgcacaaggcatttcgtgccggacaatctacacaaatatatgaaaaggatggactggctctgatgaagaccggacaggaaaatcagaaattatgggtggataaagagaaagatggacggtcatggggatatttctatctgggaacaaaggatgacgtgacctgtgcacagggggatgcagccgaaatgagggcatactttatgaaagagggagatctgaaacaaatgagaaagtctgccgagaaacgctatgctgcatttgcacagaagctggatatgaacagcgatttcccgcaacatctcactgcagcctttgacggactgtatacaatggcttatttcggcgaggacttaagaccttattggaataaagacggaaaatcaagcatagaagatttgtatgcagatgcagagaaagattataaagaagtgatggcaaaatgttatgcttttgaccgtcaattgatggcggatgcttaccttgccggaggaaaagaatatgctgaactctgtgctttggcttatcgtcagtctgtatccgctttccagatgtctgaagattcggatggagaattgctttattttactccgcaggtaggtccggtggatgaatattatccggcttcaccactatatcttcgctacaatcccgatttggtaaaagcgatgcttaatccgttcttttattatagtgaaagcgggaaatggggaaagccatttcctccgcatgatttaggaggatatcctatcgtaaacgggcagacgataggtggtgatatgcctgtagaagaagcaggaaacggattgataatgactgctgctattgctaaaatggaaaagaatgcttcgtatgcagaaaagcattggaagacattgactcaatgggctgagtatttattggaaaacggcacggataccggtgatcagcttactacagataattttgcagggaactgccctcatcatgctaatttatccgccaaaggtgttttgggtattgcagcgtatgcacgtctggcagaaatgctgaataagaaagaagaagcggagaagtatatgaatgctgccggtgagatggctaaagaatgggaaatggctgcttatgcgggtgaccattaccgactggcttttgaccaaccggatagttgggggatgaagtataatctggtgtgggacaggctgcttggcttgaatcttttcccggagagagttattcagaaagagacggatttctatcttactaagatgaatgagtttggatgtccgttggatagcagacatagttatacgaaagtggattggacagtatggactgcttcgttgagtgctgaccgtatgcaattccgtaagcttatgttgccgcttcataagtttatgaatgagactacagatcgcacaccaatggctgatttgataaatacggatgggaaaactatagtaggatttacggggcgtactgtagtaggtgcctattttatcaggttgttggaaaaggaataattagaatcttaatgtcttttagaaggtatattcggagcaatatgatatagtcctgatacacttgaaagatataattgggagaaatataaaaatcagaaagaactttatttaaaactattaccagaggaatcttatacttttgatgcaagctcatggactattccaagtggtgaattaaacacgtcagcatatataaagatttcattggataaaataaaagaagttggtagtttatacaatgattatgtattgcctctcagaataaattcttcagtaggagagccgatagggagaagtaagtacacgaaagtattggcacatattgcttttaaaaatgatttttctggtcagtacacaggaaaaggtgtcataaagcaaatagggacaagctttacaacggatataaccagcaccaatatctatgctatcaatcagaatacatgttatatgtttgttggcgacaagactcgtgaaaaaacaacgaattatctagattatgttgtcgaaattaccaaagatgacgaaacaggtacttttgtgttaacttctccagtggaaagtttgaagtttaaatcttattcatctcaaataagtcgtaaatatacattgaattatggtgatgacagatattatatagaaattacaactgttgatttttcttatgaatatcaagactcatcttataataatgagcctgtgctaatgaattttcaaggaagttttacgatgactaaaaacgtatggaaatatcaatatccggatgtggatgtagaagattaagccatggttgctggaatgaaaatatcagtggctattctaactgtttgtttaaaccctaaattttgtatatatgaaaattgtgaagtatatagttatcgtatcattatttagtatttctgcatgtagtgatgatgatgataaaaaaaacaatgagcgacctgggaatcttgtagagttacaggttgatgtaaatgagattaatattgcgcaaggagatacccgtactgtaaacattacgtcaggtaatggggaatatgttgcgacttcggctaatgaagaagtagttgtcgcagaaatagatggaaatgtggtgaaactaaccgctgttgaggggcataataatgctcaaggagttgtttatgttagcgataagtatttccaacgcactaaaattctagttaatacggcggcagaatttgaattgaagttgaataaaactttgtttacgctttattctcaagtggaaggatctgatgaagctctcatcaagatctatacaggaaatggaggttattctcttgaagtgattgatgataaaaattgtattgaagttgatcaatctacgcttgaagacacagaatcatttatggtgaaaggcattgctcaaggtaatgctgagattaagattactgaccaaaaaggaaaagaagcttttgtgaatctgaatgtaattgctcctaagcaaattacgactgatgctgacgaaaagggcgttctgataaattctaatcaaggatcacaacaagtgaagattcttacaggtaatggagaatataaggttcttgatgctggtgatgcaaagatcattcgtttggaagtttatggtaatgtggtaacggtgaccggaagaaaggccggagagacttcatttactttgactgatgcaaaaggacaagtttcacagactattcatgtaaagatcgctcctgagaagcgttggtatatgaatttaggaaaagagtatgcagtttggactcactttgcagagatgactggtgagggactagaggctgtgaaagttgaaactaacggctttaaacttaaaaaaatgacttgggagctagttgctcgtatcgatggaactaattggctacagacctttatgggtaaggaaggctattttattcttcgcggtggtgattgggaaaataataagggtagacagatggagttggtaggtatagatgataaactaaaactgagaactggacatggagcctttgaactcggaaaatggtctcatattgctttagttgtagattgttcgaaaggtaaggatgattacaatgaaaaatacaagctttatgttaatggtaaacaagtaaagtgggacgatagccgcaaaaccgatatggactattctgagattgatctttgtgcaggtaatgacgggggtagagtatcaatcggaagagctagtgacaacagacgctttcttgatggtgctatactcgaagcacgtatctggacggtttgtcgtacagaggaacaacttaaggctaatgcatgggagcttcatgaacaaaatcccgaagggttattagggcgctgggatttctcggctggagctccgacatcttatattgaggatggtaccaattcggatcatgagttgctgatgcatatttcgaagtatgatagctggaatgccacagaatttcctatgagcagatttggggaagctcccattgaagtaccttttaaataacttttaaattcgaagaaaaatgaaagcaatattcaagctgttgatattgaactttttgactctgtttatctttccgtcttgcagtgatgatgataagtcaaagtctgaattgaatgaccccatcagtggcaatatttctccggtaggttcatttgcggtagaagctaccaataacgagaatgaacttctggtgaaatggaccaatcccagtaatcgcgacgtggatatggtagaactctcttacagggacgtggaagcgagtttgtctcgtgctaccgacttctcgccgggacatatcataatacaagtagagcgtgatgtcacacaggaatatatgttgaaggttccttattttgctacttacgaagtttctgccgtagctatcagcaaagccggcaagcgatcggtacccgaaagccgtgtggtgatgccttatcatgaaaaggtggacgagccggaactgaaactgccggaaatgctggaccgtgcacattcttacatgacttctgtcattggatattatttcggcaagagttccagaagctgctggcgtagtaattatccttatgatggaaaaggttattgggatggtgatgcgttggtctggggacaaggcggtgggctttcggcatttgttgctatgcgtgatgcaaccaaagagagcgaagtggagaatctttacggtgcaatggatgatatgatgttcaaaggaatacagtatttctgtcagctggatcgtggaatcctggcttattcctgctacccggctgccggtaacgaacgtttttacgatgataacgtatggatcgggctcgatatggtcgactggtatacggaaacgaaagagatgcgttatctgacacaggcaaaggtggtatggcgctacctgatcgatcacggttgggatgagacttgcggaggaggtgtacactggagggagttgaacgaacacactaccagcaagcactcttgctctaccggacctactgctgtgatgggctgtaagatgtatctggcaactcaggaacaggaatatctcgactgggcgatcaaatgttacgactatatgctggatgtattgcaagacaagtccgatcatttattctatgacaatgtacgcccgaataaggatgatcccaatctgccgggtgatcttgaaaagaacaagtattcctacaactccggacaaccattgcaggcggcctgtctcttatataagattaccggcgaacagaaatatctggatgaagcgtatgcgattgctgaaagctgtcataagaaatggtttatgccctatcgttccaaagagctgaatcttactttcaatatccttgctccgggacacgcttggttcaatacgatcatgtgccgtggattctttgaactttattctatagacaatgaccgtaaatatatcgatgatatcgaaaagtcaatgattcatgcgtggagcagtagctgtcatcagggtaataacttgctgaatgacgatgatctgagagggggaactaccaagaccggttgggaaatactccatcagggagcattggttgaattgtatgcccggttggcagtattggaacgtgaaaaccgatagttgaacgattcccgttcagggaacatatgaacataaaaaagccatccccggaatagacaaagtagggatggcttttttgtagtgtgcttatttaccgtagattaacatttatatcaaatgaaaatggtggagttatttcatttggggtacaagtgggtatagtgaataacatagggtcaaaggatatataataccctcctggagtacggttggtaactgatatactacacccatgataattaatataggctttatccattgaaatagtatatgtttctctatagcctgattttttatagtatttatcctttacgtattatatatataaggtataacaaataccactccctgtttttcacaaatatggtctccttaatggtagtatttattctttttctcatttctttttctaatattaatggttagaagtcaattcgctccttgaaatttttaattttaataactaaatatagacaaacagactgtccttcaagcagaaaaaaactttcttcggaaaaactttcgtatatcgtggaaaagtagtactttagcgtggtttttcacagaccatacaatgtataattaataatcattttaaatgcttgaacaagacagaattataaagattaacatcgaggaggaaatgaagtcatcgtacattgactactccatgtcggtcattgtttcacgtgcccttccggatgttagagatggatttaagcccgttcaccgtagaattttatacggaatgatggaattgggtaatacttcagacaaaccttataaaaaatctgcaagaatcgtgggtgaagtattgggtaagtaccatccgcatggagactcttcagtttattatgctatggtgcgtatggctcaggaatgggcaatgcgttatcctttagtagatggccaaggtaactttggttctgtagatggtgatagccccgctgccatgcgttatacggaggctcgtctaaacaagttgggtgaagcgatgatggatgacctgtataaggaaactgtagacttcgaacctaactttgataatacgttgacagagccgaaggtgatgccgacccgtattcctaatcttttggttaatggtgcttccggtattgcggtaggtatggcaactaatatgcctcctcataatctttcggaagtaattgatgcttgtgaagcatatattgataatcaggaaatcacagtagaggaactgatgacttatgtcaaagctccggatttccctacaggtggttatatatatggtatcagcggagtacgtgaaggatatctgacaggtcgtggacgtgtagtaatgcgtgcaaaagcggaaattgaaaccggacagacacatgataaaatcgtagtgactgagatcccttataatgttaataaggctgaactgatcaaatatattgctgatcttgttaatgataagagaatagaaggtatctcgaatgcaaacgacgagtctgaccgtgacggtatgcgtatcgttattgatgtaaaacgtgatgctaatgcaagcgtagtgctgaataagttgtataagatgacagccttgcagacttccttcggtgtgaataatgttgcattggttcacggacgtcctaagacattgaatctgagagatatgattaaatacttcgtagagcacaggcacgaagtagttatccgccgtactcagtttgatctgcgtaaagcaaaggaacgtgcacatatccttgaaggtttaatcattgcttctgataatattgatgaagttattcgtattattcgtgcagctaagactccaaatgatgctattgcaggtttgatagaacgttttaatctgacagaaatacagtcacgtgcaattgtagagatgcgtttgcgtcagttgactggtctgatgcaggatcagcttcatgctgaatacgaagaaatcatgaaacagattgcttatttggaaagtattttggctgatgatgaggtatgtcgtaaggtgatgaaagatgaattattggaagttaaagcgaaatatggtgacgaacgtcgttctgaaatcgtttattcttccgaagagtttaatccggaggacttctatgctgatgatcagatgattatcacaatttctcatatgggatatatcaaacgcacgccattaacagaattccgtgcgcagaatcgtggtggagtaggctctaagggaacagaaactcgtgatgcggactttgtagagcatatatatccggctactatgcacaataccatgatgttctttacacaaaaaggtaaatgttattggctgaaagtttatgagataccagaaggaacgaagaattccaaaggacgtgctatacaaaacctgttaaatatagactctgatgacagtgtaactgcatatttgcgtgttaagagcctggatgacactgaatatattaatagtcattacgtattattctgtacgaagaagggtgttatcaagaagacattgcttgaacaatattcacgcccgcgtcagaatggtgtaaatgctattacaattcgtgaggatgacagtgtaattgaagttcgaatgacgaatggtaataatgaaatcattattgctaatcgcaatggtcgggctattcgtttccatgaagctgcagttcgtgtaatgggacgtacggctacaggtgtacgtggtattacattggataatgatggtcaagatgaagtaataggaatgatatgtatcaaagatttggaaacagaatccgtaatggttgtttctgaacagggatatggtaagcgctctgaaattgaagattatcgtaagactaatcgcggtggcaagggtgtaaagaccatgaatattactgaaaaaacaggtaagttggtaacaattaagtcagtgaccgatgagaatgacttaatgattatcaataagtctggaataactatccgtctgaaagttgccgatgtccgcattatgggacgtgctactcaaggtgttcgtctgattaatcttgaaaaacgtaatgatcagattggttctgtatgtaaagtaatgacagaaagtcttgaggatgaagttcctgcagaagaagcagagggtactattgttagtgatctgactactgatcaggatgttgacaatgcagatactgctacagatgttaatgaaaataacaacgaaattgaggaatagacataatattaataattaatcaaacaacaatcatgaaaagagtattattttcaatggttttattgatggccgtaagcttatcattcgctcaaatgaagaatgtaaaagaagccaaaagcattgccagtgatgtaaaaccgaattttaatcaagctgaaaagctgattaatgaagccattaagaaccctgagaccaaggatcttcctgacacatgggacgttgctggatttattcagaaacgttttatcgaagaagaacgtgataagaaaggtgttctgaaacagccgtttgacacattgaaggcatacaacagcattttaaaaatgtttgagtattatactaaatgtgatgatctagctcaagtacctaatgaaaaaggtaaaattaaaaacaaatatagaaaagcaaatgcttcaactatattggttgaacgtcctaatttgatcaacggtggtattcaattctttaaccttgataagaataaggaagctttgcaattctttgcaacatacgtagaatcagcttcttatcctatgttggcagagcaaaatttggctaaaacagatactcttttggcacaaatagcatattacgcaacattggctgctgacagagtaggagataaagatgcaattattaaatatgctcctgctgcattggatgacaaagatggcggtaagtttgcaatgcaattgatggcagatgcatataaagctaaaggtgatactgcggcatgggttaaatcattggaagaaggtattttaaaattccctggaaatgattatttctttgcgaatttggtagattactatactagctctaaccaagcttctaaagctatggaatttgctgatagaatgttgtctactgatgccaataacaagttgtatctttatgtgaaagcatatctttatcataatatgaaagaatatgataatgctattgagttctacaagaaagctattgctgcagatcctgaatatgcagaagcatattctaatgtaggattagtgtatttgatgaaggctcaggattatgctgataaagctacaacagatatcaatgatcctaaatatgcagaggcacaagctacagtgaagaaattctatgaagaagctaagccattctacgaaaaagccagagctttgaaacctgatcaaaaagatttgtggttacaggggctttaccgtgtttactataatctgaacatgggtcctgaatttgaagaaatcgataagatgatgaaataattatattaagtcagttattataaaagactatcccaaaatttaaattgggatagtctttttatttttacaaataaagaagcttgaatgatgattctgatttttatcaaactatataatgatgattctctttttgtgagaaaataaaaaagaggctataccaattttctattaaacataatcatcattattccctaaacgtaaacagcttattttcgttctttctcatcatccgttaataacaagcaatggcgtatcagaatggaaaatcattttacgagcaatgctcgggttaaatgaaattcgaacgatagaaatcgccaagaagttcaagctgataaggactaaaggtcatgtcactctttttcatcttttattcattttagttgatacttatagtagtcaaccaaatccagggtaagacatttagttgataaacaggttaagccagggtatactatatgcaaagaagcggtaaacgggcaaataaccaccatcttgatgggaattattcgatgaaccgattgggtatcccgctataggtcaatgtgattttatgcatcgcccttgtcaccgccacataaagcatacttttatctatggtggaatgataattctgattatcagcttgtggaacgatcacttcatcaaattccaacccttttgccatgtgtgcggaagtgacaacaatgccttttgtataagctgaacttagacttgacaaaaacgatatgttatctgtatggacttggagtttctgagcaagcgcttttgcctgagtttctgttttacagattattcccaaagatgtatatccggagtttctgaagtccgataccaaattaacaatgcctgtcgtttcttcttctgcattcttgaatggaaaaatttcaggttgttctccatgtcgcataatgggttccagttcattgtttgcctgaattttctgcgccagactggtaatttcaaaagtagagcggtaactcttacatagtttcattacttctccggtggtaaacgctttttgaatcatggcagcagttgaagaaccatagggattgacagattgagaagcatctccaagaattgttttccggcagggataaagtttttggatcaccttgtattgtatgggagaatagtcctgcatttcatctatcagaagatgcctgatatgagtttgagttctatttccatccaatgcgaggtgcagataagccaggggagccatatctgcatattccagcatacgattctttcgcatcttgaacatttcaggttttccggcccattcgaaaaagtctttatagatctggaggtcgttatttcctgaaaacatattcttaatttcttttctcagcagatttttctcagcggtagtcactgtaaggttatactggattttcatcatttccagaatgtaatctgtcatggtttcaaatcgttggcgtatggggtaacgatggaatcgtttgaactgttcccctacgaattctgcgggaatagtgatatacttggtgagttttacatcagtcgctctgaaatagtgattttccatatggaggatgaatttgtccagtcgggaaacaaattcgaaagaagctttgtattgtatccgttcgataaaatccggagccggcttttccagtagttccgaaacttgtccgaagaaattctgatacttatatttgttatcgaggacggtggagagaatttgttccatgctggtttccggtacagtcgtttcaccaagttccggaaggacattggatatgtaatcggcaaatactttattaggtgagatgatcagaatatctttggatgaaatttttcctttttgtgcatagagcaggtaagcaatacggtgtaaggcaatagacgtttttcccgagccggcgactccctgtatgatgagtacgggcgtatcttcgttgcggataatccggttttgttcgcgttggatggtcataacgatgtttttcatcttgtcgtctgcattggaacagagctctttttgcaggatatcatcatgaacagtgacggaactttcaatcatatattccatcttacctttgcgaatgcggtactgacgcttgagtgaaatctctccatgcacttcacctgacggagaagaataagtggcctcacctgactcatagtcataaaacatacccgaaataggtgaccgccaatcatatatcagatttcttttgtttttgaaatcgtagaatgtgtgtatacctatatatacaggaagttttttgccgctgcttccattttccttaaagtcgattcgtccgaagtaaggaatatccaatatcttactcaggcgattgcgtttgtctatcacattttcgcctcgtgcaaaatgattcagtatactttcacgcatggaacggatttcatgaggatcgatgtctttattggaccatagataatctttgtattcctgcagagtatctatgtgctctttaacagacttgtctgtgctgtttatcgtatcattgatgatattgagcacctgttgcaaatatgctttttcctgctcttctgtttcgttgaatatcatatataaattcagtttgggtattaaaagttgattgaaagggtggcaaagttagctagatccggtggggtattaaatagttatttatagctatatatcaagcctttttcttatttttgcgtgctcatttaatctagaagaaagatggatatccttgatgttgcaagacgaaatcagcagaaagcatgggaaataatagagaaagtcaatgttatcccgatatgggaaagtattggtgcacaggttaatctggttggttctcttcgtatggggttgctgatgaaacaccgggatattgattttcatatatatacgtcttctttaagtttagccgatagtttcagggcgatggcgaagctggcggaaaacacgtcagtgaagaagatagagtgcgtgaatctgctgcatactgttgaggcgtgtgttgaatggcatgcctggtatcaggattcggataatgcactctggcaaattgatatgatacatatccggaaaggttcccgatacgatgggtattttgagaaagtagccgaacgtatttcttccgtcttgacagatgagattaagcggacaattcttcaattgaaaaatgagacacccgaaagtgaaaagattatgggggtagaatattatcaggctgtcatacgggatggagtgcggacttatgccgggtttgaagaatggcgaaaagagcatccggtgggaggagtgctggaatggatgccttaatcagcttaatatccccgtctcatatcctattcggatggcttcaatggaattttgtactcctaatttccgtaatagattctgtcggtgaatattgacggtatgaatgctgacacacagtttgtctgctatttctttacttaacagtcctttttggatcaggcgtaaaatttcagcttcccgtttggtgagaggattgaaggtctgcagtgacggagaaggagagaacatctctccatttttcagattgagtacagtacagtctaccgtttcggcctcttgttgatcaggtgagatatccatattcccaattaccagccatgcttttccatcgatggtctgctccagaacctgatgcctgctgacaacacgcacgtattgttgcctcgcattgagaacacgaaaactgtaaatattagaatagtcatttcgttgttccggaggcaaactgtatataaactgacttaattttatttgtaagatgagcaattgctcgcggtcgtcgggatggatgcgcgattccagataatcaccctgcctttccaatgttgctatcttgtgggcatcatatcccagtaaatctacaaagttcggagaagcataggcatatctgcatttatatacgtctactacaaatgtacagttccggttcatcttcgagaattgatgaagcatggatttattccgttcccacacggcatagtcgatgtcggtaaaggacaaacgttgctttgcccacaattcttcccgtgtgatatctgttagcttgatttcccgcatgtatggaactgtttttttgattgaagtatgacaaaagtagatataatccgtgatattatcaaggaaggagtagagatttgcttattcttattgtttccatacaataatcgtgctaacaaatgataattattgaacatctcttgaaaaataaataataaaaagatagttatctaattaattgtgttatctttgttcccagagtttgagtcacgaatcattattgtgtagttcttctttataatatattattagtaagtagtcctcttctgtaattatcctcctcactccaaattagtatttatttttaataaaattttagatgaacatttacatttcaggtttaagttatggcacaaatgatgctgacttgacaaatttatttgcagagtatggagaagtttcttcagccaaagttatttttgatagagaaaccggcagatccagaggattcgctttcgtagaaatgacgaatgatgcagaaggacaaaaagctattgacgaattgaatggagttgaatatgaccagaaggttatttcagtgagcgttgcacgtcctcgcgctgaaaaaccgtcatacggtggtaaccgtggaggtggttataacaattcaagaagatattaatatcagaataaataaaagcagaagataatgtcttctgcttttatacggattaaaatagaaaaggattataatattgattttgatatggatagtctggttgaggcgactgtgaataaagactaagttccaactttcctccccttttctttgttctttcagccggaatagattacttttgtcttattccgtgagcaatgaactaaaataacaggaaatatgatagaagatgtgaaaagaatcccatatggagtttccaatttcgtggaagtggtagagcagaatcaatattatgtagataagaccatgtatctgcctctgctggaacagcagcccaacagtctattctttatccgcccccggcgtttcggcaaaagtatcttcctgagcatgcttcgcacctattatgatatttcgcaaaaagaaaagtttcagaaacgctttggtaatttgtggataggcagtcagccaactcccctacagggaacttttcagatactttttcttgatttctcacgcataggcggaatcgacggtacattggcacagaactttgacgattattgctgcggtggattggatgacttcgcatccatttatgaaccatactattatccgggatttgcattagaaatgaagcaactggaaggttccaccaataagctgaattttctggatcgaaaagcccgcaacaatggttcccatctctatctgattattgacgaatatgacaacttcaccaacgtggttctgaacgaacaaggtaatgaaatctatcatgccctgactcacgccagcggattctaccgggagattttcaaaaagtttaaaggaatgttcgaacgcatcttcatgacaggtgtcagccccgttacattggatgatctcaccagcggattcaatatcggctggaacatcagcaccgatttccaattcaatatgatgctgggattcagtgagacagatgtgcggaccatgtttcagtactataaagacgccggacaactgccggcagatacagacatagatgcactgattcgggaaataaaaccgtggtatgacaattattgctttgccaaagaaagtctggaacgtgatccgaagatgttcaactgcgacatggtactttattatctgcgtcattacataacgttggggaaatctcccgaacaaatgattgaccctaatacccgcacggattacaataaaatgaaaaaactgatccgattggacaagctcgacggaaatcgtaaaggtgtgttgcgcaaaatcaccgaagaaggagaagtcatcaccaacttagtgacaaccttccccgccagcgaaatagccaatccggaaatctttcccagcctgctcttttattatggcatgctgaccattaccggtacacgaggagtccgcctgatactgggtattcccaacaataatgtacgcaagcagtattacgattttctgttagaggaatatcaagagaaacggcatattgacttgaatggcttaagagatttatttgatgacatggcattcgacggtcactggcaaaaatctttagagttcatcgctcatgcctacaaggaaaactcctcagtacgtagtgcgattgaaggcgaacggaatattcaaggattctttactgcctacctgagcgtaaatgcttattacctgactgccccggaagtggaactgaatcacggttactgtgacctgttccttatgccggacctactgcattatgaagtgaatcatagctacatcatagagctaaaatacctttcagaaaaagattccgatgcgaaagccgaaatccaatgggaagaagccgttgagcagataaagggatatgcagccgcaccgaaagttcgccaattgatacagaatacaaagttacattgcattgtgatgcaattccgtggctgggaactccaacgaatggaagaagtaattcaaccacatataaaatgacagcacttttgccctcacgctctcattttcgcctcaatccccctattcatcggagttacagcgattagagatccaatggtagcagcgtgagagcaaccgtttgccctcacgttactaccaattattctattttcagcaaatgataaagtgtccccttaccggacttccggcagggaatattcagcttctgaagcgcacggccgaacacagctaccttattgatagccaacctgtcccgtgtcttcgtctgcaaataattcagaatctgcatggacgtcatccattcgcctccctcctcttcttccgccggacggagataacaatggaacaactgttccaacgggctcgcctgctcaaattcacggttcgtctgcttcaaaatcttttcatcctcatcatccagccagtaacgctcacccttataaatggcttccatcgcctgagcataaagctgtttgtaattgatggtagcattggttttgataggagctatcacctcaatacagataaaacgacggctgccactgggatcggcaagcaaatctttctgattgctggtgccgataaaggaagcataacgacgcatttcacgaatagtattgccatgaggcttgcgcaagttagcaacaggcttttgcaacaaatgcttcagaaacccctgctggctgacattgatctgatcaaactcatcaatgttgatcagaaaaaaacgtcctaaataacgctccgcttcctgcttactcttgaaatcgatactgtccgtatagccgaaacgcaactcaggcggcagaataatccggcaaaacgttgacttacgatacccttgcggaccgacaagcaaaggtgacgtactgtttccatgctgccgatccacccctctccaatgcgccaccatgctcagaaaccaacgataaaacaactcctgccagtacggattcgtacaaggaaccaatcctgccaatgcacggatacggtctttcccgtcccaacggccgacatcataaagatattcttctacaggattgtgcaaaggaacatattccgaattcagaaaacggtctacatcacgatcccaggcattgatgccttctttcaaggcacagatagagatactgttgcgcacacgtttgtccacgggcttaaagtaaaagtggatggaatcacgctggcggtattccagatcatctaacacggtgttataacgaaattcataacgacggttcataaattcttccagcagaaaagccgtctcctgctcccttccgatactgtttttcttgccaaaacccttacattcctgataaagattatgaatcgtcgagcgtatgattcgctcatcctcttcccgatagtaatgaatgagtgtctgccggaccgcttcttcttcggggatacccgctttgaaacaatgctcggcaaggtgtacaagcaaaggttgcaaatcatctccacgcttccagtcttccatttcctgaaatgccctgttcaacgccgcttcataaatcttcgtgaaagtttttgcagactcatatcccggtttcaatcgcaacaacagattcttttcaccctgcttgcgctgccggaaagtttcttcaccgggcatagcgagcggttgttccagacagaacggcactgcatcgggattgtaatatggagattcgtccagtgtcatgcgacacttctgtgtcagcaccggtgcttgcagattaatatcataaggaagcatcggctggtagcactttaccgccagccagtaggcatgagcatgaaataattccgcttccgcttctttttcgggcagtcctctgtcatccggcagggcaaaacgcacccatatcttcacgctacggccactggaaccacagaatgcggcgaaagtctgaggcaagagtgccgcctgccgtttcacatattccatttcggacgggcctgccagccggttcacttccaactgcaccagtccgttatattgtttcatttttcgttcgccttctttagtgcgggtacattctacggcagaatagatatatggcagtttgtctatatgttcgtactggctgtacgtaccttccagcatcggtatcaggtttcgcaaagccgtaatgtgtcccgattttgtctccgttttcattttgttgaataatgtacctgcttcgcatatgcttagagcttcttttccactcccgctgtcttgtctgattaaagttattttcattcttttttgtctgtttatctaccaatattgtttatcgcttaattcctgtaaaggtacgatattatattacggcatacaaacttttcctctaataaaaacagactttttgctcgcattaaccttataataaaatacgacatcaatcacacgtagatggttcatttcttaccatgatttccctatatcattgtatctgaatggcttacagtttcctttaatttctgtagtgtactgaataagttgacacttcaaaaatcgaaaataaagatgaaatattcgaaaaagaagtacaactattacagtgatgatgaacgaatgtcttatattcgtgagtatttatcaagtccgatgattatcatatgggagatcattcttatgataaatttcgtaatacaacatgtaactcatttgattactctattgctacttcttgtttaagtgctagaataatttcaatagattgtggaatctcatatgataaattcaaagtcttaggatttcccagaaatgatttgttgatatcgaaaaataattgcaatgttattaaaagagaaatttcgaaatttgcgggatatgatgtaactaaatatatagtttatactccaacttttcgtgattatgagactgttactgaaggtaatttgcgttcaatactcggatatgttgattgtgatttgttgaagttatcgaaaatactattgaagtttaatgcggctttaattcttaaattacatcctttgcagaataaaacagtcttaaaaaaagatttacccaaaggtatacttgtttttgaacaaacatataaatatggattgtatgatcttttgtcattttcagatggaatgattactgattatacttctacctattttgattttttattggtaaataagccagtcatatttaatttctacgatattgaagaatatcgtagagtaagaggtttctcatttgagccaatagaatttttttgtgcaggtgatattgtttacaattataatgaattgatagatgctgtgatgggacttctggctgggaaagatattcatgctgaacatcgacgtcatatttctttattgatgaatcaatttcaagatgataattcaacaaagagaatatgtgacatatttttaaatgaaatataataaataaaatgaattatgcatttgtggtgcaggcacgtttaggttctacacgtttgcctggaaaaatattgaaacctttctatggtaatcaatcgattcttgacttaatggttcataagctttctgctatatcgaatattccagtaattattgctacaacaaattctgttatcaatgaacctattgaaaagaaggcacttgcattaggggtaaagtgcttcagaggtgaggagaatgatgttttaaaacgattcattgatgttgctgaatattttgatatacagggtatattccgaatatgttctgataatccatttttagatgtacatgcggcaaggcaattggtcgaaatagcaatgaaatcttgtaacgattatataagttttgatattgatggtactccatcaattaaaactcatttcggtttttggggagaatttgtaacgcttgatgcgctgaagcgagttataggatttactgatgatttattgtatcgtgaacatgttactaattatatatatagtcatcctgaactttttaatattcaatggatttcaggatctccagtcgtgtcaaaacatcataatattcgactcacgattgatacgttagaagatttttctgtagcacagagaatatatagggatttacaagaaaaaagagtggaaatatcgatagaagtgattgtagactatgttcgaagacatgcagaatacattcaactgatgaaacaacaaataaaaaaaaattctaaataatgaagaatacttatattattggtgaaatagggcagaatcataatggttctgttgacttggctaagttgattattgaattaatctcacgacctgtacatgaggatgtttttggtatggatttcatgccaatgaatgctgttaaaatgactaaaagagatttatcagaagaattggctgtttctcaaatgaatcaaatatatgacaatcctaattcttttgggcgtacttatggtgaacatcgtgcttttcttgagcttgatgatcaagcgcattttgagatttataaatatgctaagtcattaggattagattttatcgagacgttatgtgccaaaggatgtctgtctttgcttaaactgttcacaccggataggctaaaagttgctagtcgtgatttgactaacttaccattgcttgaagcattagcagaaactcatattcctattatattatcgacaggaatggctggtcaaagagaacttgacaatgcattagatgtgataacgagatatcatagtaatatagctattctacattgtgtatctcagtatccaactcatccaaataatttgaatctacgtacaataacatatttgaagaagcattacaataagtttgagataggtttttctgatcatacaataggtatttctgctgctacagctgctgtagcgatgggagcggaaattatagaaaagcatgtaacaattgatcggcatatgaaaggaacagaccagcttggctctttaggtccagatggggttaatcgtatgattcgagatattcgcatagcagagtgttggcttggtactgaagatctttatatagaaaaaggggtggagaagtctaagataaaacttgaacgttctattgccactcgaaaatatattccagcaggtagtattattcaagagtcggacattcatttactgagtcctggtgatggttataaatggatagataaaaaaaatgtaattggtcattttgctaaacaagatatatcagcgaatgaaataatatatcctgattttattgaatagatatattcctactgcaacttgtattacggtatagagtactgcctgctataagctaagtagtgattaataaataagggtaaaatactaaaaaaatgaaagagataaagcttatacttacagatattgatggcgtttggactgatggcggaatgttttatgatcaaacaggtaatgaatggaaaaaattcaatacatctgatagtgctggtattttttgggcacataataaaggtattcctgtgggtattttaacaggtgaaaaaactgagatagtgcgacgaagagcagagaagttaaaagttgattatttatttcaaggagtagtggataaattgtctgctgcagaagaattatgcaatgaattagggattaatttggagcaggtggcctatataggggatgatttgaacgatgctaaattacttaagcgtgtaggtatagctggagtacctgcaagtgctccattttatattcgtagattgtctactatattcttagaaaaaagaggtggtgaaggtgtttttagagaatttgttgaaaaagttcttggtataaatttggaagattttattgctgtgattcaatagttgttgtaaaagatgaaaaaggtagatataattcatggtggatggcttaaggctcctaatggggctagttctgttcttaggactttagctgaatctacttcaaaatttgaagaatacggtattcagctttcggtttattcaatggatttgattgtgttaaagtcatttgaaaatatagcagctataaatcaacggaaaggattacggtactttattaaaaagaatgctaatgcaaattctatactagcattcatttctatttatgcaatatatttgcggcatgctcgtaagattgttaaatattattttgatcaagggcttgaggaatcgagaatcttgtttatacatgatatttttacatgttattactatttgaagtatcgatctagaagacaaaaaaccgtgttggtattacacaataatggtgatacttttaatatgcttagacaatattatcctgtgcttaataaatcaaggctttatagtatattattatacattgaaaggaaggttttatctgaagtggataaggtgttgtttgttgctgagaatcctaaagatacttttgtacaattacatccagatattcctattgaaaaagtaggatttgtttataatggcattttgagcaaagaaatgcatatatgtccggaaaaacatctagggccacttgaaatctgctgtgtgggatctgtttcaaaacgtaaagggcaagatatgattgttgaagctcttgtgaagatgtctcctgttcaaagagagaaagtgcattttaccattgtaggtgatggtacattaaggggggaattagaaaagttgtgttttgagaaaggaatctctaaatatatagattttataggtgtttcgaatcaagtagaaaattatttgttgaggagtgatatttttatgttacctagtagagatgaaggattccctatttctattttggaggctatgcgagcaggacttcctattatatctactaatattgcaggtattccggaaatggttttttccgggatcaatggaattgtaatttcgccatgtcttgaagatatatatgatatcttgtgtcatattgaatcttataattggagtgcaatgggtaaactctcttatgaactatatcaacagaaatttacgcttgattcaatgattgaatcttatgctaatattttgaacgctatatgaaatatgtcttttggatacatagtagtacttcgtattatatggcaaaagctattatagcaaaagaaaatttagattgccataatgttgtttatttgattgatcggaacaatctaaatatggtcgcaaatataacaaaaaaaaaagaggacaatgttgtattgtcctctttttcgtaaccatttataataattcaattataaatcaaaccataacttttcccaaattttcggagattctttcggtgcattgatattagcagtcatctcttccgggctatactcccatcttctgatcagttcttttgaagttgcatcttccggcacttgtaaggtcgggacttcatttccagcagtaccagaacgtctccactgtacaaactcctcaaacggacgatccattaaatcaatccactgctgcatatgaatctcatacagtgctttctcctgagtcagcgctgtcaattccggcaaacctgtaacatatgtatcaatatccgcttccgctactccataaaatgcacatgcttcccgaatgcctttcttatacaattcattagccttcgacaaattctgagcaactcccaaaccgcgcgcataagcttccgcttccagaagcaactgctcctggcaagagtatattaactccggtgcatcttttctgaaaagataactgctcacaacagatgataacatattatctttgtcatcagtaacagcaggttcacggttacctaagcctctatatacaccgtcggcacccggttcaaaataacaaggaatacgggggtcattacgttcctgcatcggcttcagcatatagttgctggcaaaaaacaatatctgtgtaccgccaaccaattctataagttcatacttaggattctggttacccggttctgcagaataagggaacaccaaattatctgatgctgatgataccatgcctccagcctgtaacaacgtaccaatggcagtagctttagaaggatctttgtccaccataaccatcagtgttctgaactttaaagatttggccaaagtcatccatttattcatatcacctttataatagatatcgtattcatcaatcgcattggcatcattcaaatccatgatctgcagtgcttcatcaagcaatgacaacaccccattcaatacactttcctgagaatcaaatttcggatacttaattgttccgttccaagattcagtgaaagggatatccccccatagcatcgtcgcttcatacatatgttcagccaacagaatcttacactgtgcaatagcattgtgattcaccggatctgcttcttccgcatttttaatagccagcatcaagttattaccaccgacagagtagtaatgtttccacgtatttcctgtactataaggggaaatggtatataccgattcatcccagccaccataatcaagtccaccatcaacctgacactgtgaactcattgataacggaatatagaagtcaccaccggtacgtgttccggcccagtttacggctacatagttaaacaaatatccgggatcaactttctcggcagtattggggtcatggttgatatcaagccagtcgctgcatgaagtaaataacccacatgtcaaagcgctcaatgcatatgctaatattttctttttcataatcatgttcgtttaattcttacaatgttagtctgagattaaatccgaaacttctggtagaagggatactgttaaactctacaccgcctccgatctgagaaggaccgaagaagttagcttccggatcaatatgcggcacatgatctttgatgatccataagttacgtgcctcgaagcctaaatccaatgatttaacaaagaaactcttaaaccatttacgcggaaaactataggacaattgcacttctctaagtttcacaaatgatgcattatagatatttccttcattattactggagttcgccacatgctgccagtagtcctgcatactcttcaccggaacatcattaggtctgtaagttccgtcatcctgaagaataacacccggttcaataaaagaggcatcttcacggtgagccactgtttctgcagccaaaccactgcttctcaaattagctactgtttccgaatataaggaacctccatgacggatatcaatcaagaaactaaaagtcagccctttataagtaagtgtattgttgatacccattgtaaagtcaggataaacgtctcccaaacgtacgttattgactgtttctctcaaacctgtcttagagttgattacataattaccttgatcatcacgcttccaggcagtaccgtacaaaccgaacgaatcacctttggcagccttaatctgcaaaccactcaatccgctagtcaatgtatattcatcaagtccttcagccaactcttctacagtctgcttattagaagcaaacgttgcatccaagtcccatttaaagttacgtgtttctacaggagtcaagcccaaagttacttcgacacccttattggcaatctttccggcattgatattattagcaaagtaacctgttgataacgggacatcaatacttacaatctgattctttgtgatattgctataataagtcatatccaaacgaatctttccaccaaaaaaacgtaaatcagctccgacttcgaatgaactttggttctgaggtttcaagttttcattcggcagaacacgaggcccggtaaaaccaaccagtcccatgtgtgggaaagtattgacattacccagatattgcaaaaagtaagtactagctggagtatatttaaatgccaaattgtacggatcttcgtcactacccacattcgcataacttaaacgaatcttaccgtaattcaggatgtctttattctccatcaattctgtgaaaataaagctaccgctgatagatggatagaaataagaacggttattaataggcagagtagacgaccagtcattacgtcctgttacattaataaaaagcatatctttgtatcccaagctaatatctccgtataaaccgacaagacgtttcttttcataataattcaccggagtagtagatttcgcattagtatatgtatacaatccgtcaactaccaggttctgagcttgtacattttcattcttccattcttcctgatagagattatgacctaccatcgccttaaaatgataatcattggcaaaagtcttctcataggaaaccattaagtcattatttataattcttttatacaaattccaagtctgaaacttaccatttaaggctcctacagtaccctttgcgtaaagtttacgtcttccttctgtatagaagtcagttccggcattgttagtgatagtcaatccttcaatcggcttataagtcaatgtgatattaccgatcatacgatccagattattggtaaatttattcttattaataatccagtacggattattacttttgccttccggatccaacgtaacctgtttgccattttcatcaatccagttctgcttaatatcatgaatatcaatcgttcttggcaatccattgattaaaggaatcagcaagttgctatcatttgccccctgtgccggacgaccttcagaatctgaacgtatatattgggcagagatgcgtcctgtgaagttgctagtaaagttcatacctgcattcacagagaatgcatatttgttatagtcagaacctggcacaacaccggtctgattagtagaagtaaagctcaaacggaaatcagccttttcaccacctccggctactgacacattattaatatagctcattccggtttcatagaaatccttcacattatcaggatttgctttcaaggtcactttatctcctttataatctgtaaattgctgatcttgtaccgatgaaatcttcggtccccatccattcagcatttttacattatatactccgtagctaccttgtgcatactcattctggaaatcaggcaatttaagtacattctcaaatcgtgttgaagagtttaccgtaacaaataccggtgaattcttcttccctttcttagtagtaataacaattgcaccgtcttttgcacgtgctccatacaatgcagttgcagctgcacccttcaatacgttaatagattcaatatcgtcagagttgatatctcctgcacggttacctacatcgactataccattggttctgtcaggattgtaagaaccattgtcaataggaagtccgtcaataataaataaaggggaagaaactgtgccaatagaggaagcaccacgaatctgtatacttgaactaccacctaccgttccagacgactgtgcaatttgcaaacctgcaatcttaccggacaatgaattaagcacattactttcacgcgctttagttatctcatctccttttacactggatactgcataacctaaagatttttcagatcgcttaatacccatagctgttaccactacctcttcaagattctgagaatcagactttaacaaaactttcaaagtaggtttgattacgacttcttgtgtttgcataccaatatacgaaatctgcaaagtctttgcagaacttggtacgttcgccaaattaaaattaccatcgatgtctgtgattgtaccttgagtagtaccttttaccaacacagaaatatctcatgaaactatgaatcaacaacacgatcctccacctgttttttaagtatgtaatgatccctttttactttttattttatttgaattaaatttaatatcttatgaaatctaatttatttatgaagcgaaagcttgaaatcggactatctttattaattggaacgtccgtttttggaggatgcaataatgacttggctccgatacgccaaagtcagacttttcctcccaatttgaatgcaccaactgtttttgagagtttctctcctgatagtggtggcgtaaagactcaattaattattcgtggacagaattttggtacggatactgcctatctgaaagtgactgttaataataagcgtgctgctattgtaggagtagcggatgatgtaatttacgctattgttcctgcgcgtgctgatactggttatgttcgtttatttgtgggcaaagatgataatgtcgaagaatatgcttcccaaacaaaatttatttatcagtttaaacgtaatgtaacaactttgatgggtagacaagggcaaagtgggcgtgatgacggaccatatgctgaatgtaaactacaacgtccttggtttgctttggcggataaagatggtgccttgttttttattgatgaggggcgtggacaaaataaaaatggtgctttgcgccgtgctcaggaaggctgggtggaaactttggtgcaaaattcgagtggtccattccaaagtcctacctgtcttgcgtttaatcccaagcaggacactctttatatttctaatatgtcctacggaagtgatataaaaactagttttaacatactatatgtaacacgtgaaggtggttttatggatgtgaaagggctatgtaagtttgaaaaagcagaaacgcaaggtttagctgtgcatccacagactggtgaaattttcttttgtaataaatctggtggatatatttatcgctttaatggtcccgattatgaggattatgaaccattattccaaataaacagagcagataaaatagatactcgtatggtttttaatcccgaaggtacggctttattcgtggtagtttgtaacagacattgtatctataaagttccttataatgcattgactcatacttttggtgagcctgaactattcgcaggtggctgggatgaatccggttatgtcaatggtagtggggtgactgctcgtttcgataatccgagacaacctgcttttgatcaggatgggaatatgtttgtccctgaatatggacgacatactattcgtaaaattactccaacaggtgaggtgtctttgtatgctggattacctggtcaagcaggatttacggatggtcttccagagaaggctagatttaataagcctgaatgtgtgacagtttatttagataattcactatatgtagccgatagagataaccatcttattcgtcgtgtaacagtggaataataatgtataaaaagatatattcatgaaaaatacacagaaatatttcatattacttttgatgttgatattacttgttccaagcaatatatggggacaagaaacaaaaaaggaaattatagtcaaaggtgtagtggaagatgatttagggccgataattggtgcgtcagtcgttgctaaaaaccaggcaggtgtgggagtaatcacaaatactgaaggtaagttttctttgaaagtgggaccttatgatgtattggtagtgacttttgttggttatcagccatatgagctgcctgttctgaaaatgaatgatcccaataatgtaactataaagttattggaagatgttggcaaaattgatgaagtggtaattacagccagtggacttcaacaaaagaaaactctgactggggcaataaccaatgttgatgtaaaacagttgaatgctgtaggaagtagtagtctttctaattcattggctggtgtggttcccggtattatagccatgcagcgtagtggtgaaccgggtgaaaatacatctgaattctggattcgaggtattagtacctttggtgcaaaatcaggagccttagttcttatcgacggagtagaacgaaattttgatgagattttgccgcaagacattgaatcgttctcagtactgaaagatgcatcagcaactgcaatatatggtcagcgcggtgcaaatggagttatcttaattaccaccaagcgtggggaaaaaggtaaggtgaaaattaatgtaaaagcaggatttgactggaatactcctgtaaaagtgccagagtatgcaagtggttatgattgggcgcgtttagccaatgaggctcggttaggacgctatgattccccgatttatactcctgaagaattggagataattagatcaggtttagatactgatttatatcctaatattgattggagggatttaatgttgaagagtggtgcacctcgctattatgctaatattagtttttcaggtggtagtgataatgtacgttattatgtctctggacaatataccagtgaacaaggacgttacaaaacgtttagctctgaaaataagtacaataccaatacgacttatgaacgatataattatcgtgctaacgtagacatgaacataactaagacaacagtactgaaagttagtgtaggtggatggttggtgaataggactacgcctactagaagtactggtgacatatgggaggattttgccaaatttactcctttgtctactcctcgtaaatggtctacaggacaatggccgagagtggatgggcaagatactcctgaatatcatatgacacaaagaggatatcatacgaaatgggagagtaaggtggaaactagtgtaaagttagagcaggatcttaagtttattacgcccggtttgaagtttgaaggagtatttgcttttgatacttataatgagaatataataaaacgggagaaaaaagaggaagtatgggaagcccaaaaatatagagatgaaaatggtaaattgattttgaaaagagtggtcaatagaagtccgatgaatcaaaataaggaagttaggggtgataaacgatactattttcaggcgtcattagattataaccgtttatttgctcatgcacatcgtgtcggtgtttttggcatggtataccaagaggaaaagacggatgttaatttcgactccagtgatttgattggttctattcctcgtcgtaatttggcttattccggtcgttttacttatgcttataaagataaataccttgctgaatttaactggggatgtactggttcagagaattttgaacatggaaaacaatttggtttctttcctgctgtttctgccggttatgtaatttctgaagaggcttttatgaaaaaagcattgccatggatagatcaatttaagatcagagcttcttatggtgaggtaggtaatgatgtattggatggtcgtcgattcccttatgtgtctcttatagatactgatgatggaggatcatattcatttggggaatttggaacaaatagagtgcaagcctaccgtattagaactttggggactcctaatttgacttgggagatagctaagaaatatgatgtaggtgttgacttttctttttttaatgggaaaattagtggtgctttagattggtttttggataaacgtgatgacatctttatgcagcgtaaacatatgccattgactaccgggcttgctgatcagactccaatggccaatgtcggaaagatgaagtcttatggatgggaaggaaatataggatttactcaatctattggtcaggtgaatctccaacttcgtgccaactttacttatcagactactgatatcatagataaggatgaagcagccaatgagttatggtataaaatggataaaggctttcagttaaatcaatcgcgtggattgattgctttaggattatttaaagatcaagatgaaatagaccgtagtccgaaacagacaagtaacagacctatccttcccggtgatattaaatacaaagatgtaaatggtgatggagttattaatgatgatgatattgtgcctttaggatatcgggaagttccgggattacagtatggtgtcggtttaagtgctaattggagaaattggaatttgagtgtacttttccaaggaacaggtaaatgtgatttctttattggcggtaatgggcctcatgctttccgtagtgaacgttatggtaatattttacaggcaatggtcgatggtaatcgttggatacccaaagaaatatcaggcacgactgctactgaaaatccaaatgcggattggccgcttttgacatatggcaataatgataataataatagaaaatcaacattttggttgtatgaaagaaaatatttgcgattacggaatgttgaagtcagctatgattttccacaaacttggacgcgtaaattttttgtaagtaacttacgtctaggctttgttggacaaaatttgttgacatgggctccttttaaaatgtgggatccggaagggactagagaggacggatctaactatccgataaataaaacattctcatgttatcttcaaataagcttttaatcttttaatattaagaatattccgcagaagtgacaaaattatgtcaaaatgaaaatgctcatttatagaacagaaaggagaaataaagcacattataaacatctatatatcaacacatagcattcattcacgtacaaacagagcacaagtttgcgcacattgtatcaagttataatagccgccttttcgccacttttattaaaaagtttattcgtaagcagtaataaataaaatctatacagacatgaattcaaatatatctgtcaccccaaacgaccaaagaacagaaggaatgaaggaatcccgaatcattaaccgaaagactttgaaaaactaatttcttatcagtccaaattcattcgttctactgtagtttccctttcgttccactatagttggacgcaagaagcactatagttcctcttgcgcccaactatagtggaacgaataaataaggacctcgaaagacttaattatccggaattactgatctaaggattcgggtaatacatccataaaactcaattagtaaagaataagatagtggggatagcattatcggagttgctcccgataatctttcggcgtcattccgaatcggcgggtaaactctttataaaaataggaacggctggaaataccaacttcagcgataacatcctgaatagaaagttcttcattctgcaacaatcgtgcagccttctccatccgataactctttatcaagtcactgggagccgcattggatatttctttaaacttgcgatagaattgacgcggactcatcgccatacggtcggcaattaaggttgatcccaattcttcctggtcaagattttgttctatcacttgcaacagtttccggataaagtccgcctgttcttctgtagtacaaacaatgcgtccggcccagtcaccaagctcttccatataaatctgctttgcctcccgagtaccgtaaatagctttattgacggcttctttcaaaaatataatatcataaggaagtacaatatatgaatcagcccacataatcaattcgcgctgaatggacgaacttactttccaacttaacattggaataaatgccgttttcgaaagttgagtacgattcttattcacatattccaggaagtcactctctgcttttgcatacatcaacatatcaactagtaacaaagcaggagccgatctacgtatttcttcaaatgcaagttgtacacttttcaccggacaaacaacaaattcatctgctaagagatcacttatcagccataccatttcatccctatcctccagcagaagaaccgttttcttcccatgctcttcagtctccttgatgatagccggttcaaaggctaacgtcaataaatgatccttttctctgtcggcatagtgaagcgtaacatttagctgtctcaaagccgcttgcacagaaaacagtaattggcgggtagttatcgcctcttctgtttccttactatctcttcttccctcttcttccgaaccggaaagttgcttatataattccttcagagtatcatctacagcagagaactgcaacaacatccgtccttcctcttccttcacatccactacaatatccgacttatgttttactccgccaatataaaggtaacaccaatagagcatacagcgtaaagcattcttataaacaggataaacaaagtgttctggtatagcaagttttacagaagatatatcaacgccctgtccttccaacacatgcaagacttctatagagagctctttcatgcacatacaaccagtaatcgcatattccgtagggaaaaatgacttaagttcctctacagccaaagttcccgaacggaaaagagttgcaataaccgtctcgtgtacctgctccataattctgagacgctgttcataagggagattttccgcacgcaactgatcacaagagcgataaatggacgtaaaacgattcagtaactcacgattaagactggcggactccggtagagcttcattgctttctgctgtcaacagccgctgcatcatacgcttctggagaaaatattttcttaataaatgaatcagataaccggctattaatatgaaaaacagcaagtaaatgacataggctaccgtagaaagataccaaggcggaagaatgtacaaagggatagaaaataccttatattccgtattaaatacatctttcttataacggacctttaaaacatagctacccgaaggtatttctagatacgatgcttcatttatactactaaacgaggtccagtctttatcaaatccgtccagcatataggagtactccacatcacctccagtaagaaagtctggaacaacaaaagaaagggaaaaagaagccttcgctcctttaaaacttaacgctttgccaccatcggtataataatcccccagattaacctccttacgtccaatcattagcttacgcaataatatgttcggatagaattccggagctgtcgccacttccttatccagataaagcaaaccgtcaatgcctccaaagaaaagacgtccggtataaggacattgataataggcatcatcactaaactcgcccacctgcacaccggcggcataataataagcatgcgaagaagtgtttttgggattatatttaataagtccacgattagtgccaagccataaaaaaccatttgcatcctccaatatgccatgaatcatatcattaagcaacccttgttctctaccgatataggaggcactgatttgttccttattaaaggtcaaacacactagtcccgatgttgttcctacatacatcctaccatctttagcacgatgcaggctaagtacatcatcaacagatttatgcaatatttctttcaaagaaatgactttatattcttctgtctgtttatcaaatcgaattaaccctttttcccggcttcccaaccaaagaatggaatctccttcagctaacataggataaaacatggttatctctttttgttcataaaagaaatgataacgcttttgcgatttgaggtgaatctccccttgtttcctctccaatatcaatttacgaaatccgaccccagccgtaaccgcatagagtacgctgtcattctcttcatagatatcatgtatttcgataacaggatctgcagacttatcctcaacacaatgcaaggctttatctgcaaaagaataataaaacagtccgggattacccgatcctacccaaaagccatccatataacggctttgttttaatgagtatgcttgaaactctctattccaacgggtataagatgaggcatcctgcctgcctactggagagtaaactgtagtagcagaagcatccataccaccttcataatcatgtacatgcaaaagtccatctcctttcgtaccaaaccataatccgccatatttgtctgtcatgacagaacgtacctgccgacttagattggatgatagtttgctaagcatcagattagtggctatcgagtacttcttagcgtacatgacagctccctgcccatcagaagctacccaaagaatattctgatgaggatcgcggaaaatatcatatatacgtacattacggtccaccacttcttcttcatattttttcgaggtgcgcaaacgtactaaaccattggtttgaaaagcaattataatgtcttcataaaaaggaacaattcccacaactttcccatatcgttgcaccaacgaagaaaggttacgaatatagattttagaccttctggaaatatcatatacataaagttcccgctctgcatccacaaaacagagaatgccattctgataaaatacattatcgataggttttgcatgaaaatcagaagatgaaacagtaggatggacagacaatgtatcccggtcaaagccatctaatgaacattgaatcagactacctgtattccgtggaaaagtccataagacaccatcatccgtgacaaaagcacgctgatccatattctcgacaggagtctctatatttttgagatggacaaactttttatgataagtattataataaaagattccttcatcgcttactacccaagtatctcctttcggattggaatgcagataataatcacctgtaaaatcataatatcccactacctgacgcgaatcttgcgaaaaacgattaactcccaaatgtgtagtaatccacaaacaactgctatctgcctgctgaatagaatgaatgacattgttactcaacgtctttttcattgagaaatcagaacgaaagacctcgatacctttcccatcataacaattcacgccatcataagtgccaaaccacatcagccctgctttatcctgatagaggcaaagcacagcactattagaaagcccttgttgataatcgactttccgaaaaagataagcatctttacccgcatcagcccaacagaccaacgaaccaataaatgtaaaaaggcataatatcagacatcttctcattatattaatagcaagtgttattgttcatgtcttattagataaagcgggaacaaatatactaaatataatataaatgagacattaataagtaagaaaagtaacaaaagccatcggatagacattgaaaagagatggaggagacaataattctggaaaaggtaaaagcgggagatgcggctgcattttctttgctgtatgacctttattggctgaaggtttataactttgcacgactttatatcacttcatcttccgtgatttcagaagtagttcaggatgtttttgtgaaagtttgggagtccaaagagtttcttgatattaccaagaattttgatgggttgctttttatgattacccgtaatattatattcaattattcgcgtagacattttaacgagctgaattttaaaatgacagttctgaaaggacttgaaaattcttatgatatagaagaggaattggatgctgctgatttgaagaactatattgataaattgatttcgcaacttccggccagacgacagcagatctttagaatgagccgcgaagagcatctatctaatcgggaaatcgcggaacgttgtgcagtcagtgaaaaagcaatagaacggcagataacattagcattgaagttcatcaaagagaaccttcctttatttgtcgtatttatgggataaaggctcaaacgtattcatacccatgcttgagtctgaatacgtttaattggctatatggtgtttcttattttttcagtttaaagaaaggattcttgctaatcttgacatccgaaggtttcatcttttcaattgtaacaatacgtcctaatacatccccttcaatcttattgtttgaaataactacagatttacatgcttccagcgtaataccttctttgcgatagtgataaggctggtaagtcgtatcacgtatgagtgtattggaggagaaggtgagcccgtttaccgaacgtgcgaagagtatcggataatcaaataggtggaaggtattatccataatgcggatattgcgatgataggggtacttctgttccggtgtcggtatttccgggtcaatgctaatcacagcttcacagaattgataaattgaagaattgcaagggtaacggaaatcattgttgcgtatcagcacatctttgacagctcctgattcataccatgcgtttgcgtctccggcaatcagaatggcagagccgctggattcgaatacattgttctcgataataaccttgccgggagtagatacaagcagaccacgtgcccggcaacttccgaaatggcagttgcgtatttctgcatcaggtgtgcaggtcagattctctattacatatccggcttccactccggctggaagtggtactgataattcgatgataaattcagctttattcagtgcttcaaatttattcattttaccggtagctacggtacgcatggttttatgctctataaatccgattgtttcgtctgggcgtccccattccatcccttcactcatgtcttgcatgaacttgcatttgatacgggtaggagaaagaacttccataatacgggaacatgttccatggatgttaatagggtcatccatcaatcctgcccaactacagttctcaatcttgagtaatccgctgcatcccatgaagtggaaaccgtcgtcatgtccgctcagcacacgtttcttggaagtgttagggatgatatgtacatcattgaaagagatattcttgctatattgtgacagaattcccagtccgcaggtatggaatagctttacgttctctagctttgtatccatactgtggtaaatgaagataccggcgtgatctctggtgctgtgtcgtaacacaaggaccgtacccggcgcagggaagaatttatcagcctcctttttaggatcggataagcgtattaatccggggtttatttctgttgcatcgtatgagcgccagcctaagttatcacctgtatttggcaggacgagatgggtgtcgggatcaaactgcatgatcgcccaaagactgcttttccatccttcgccgacaaaagtcagtcgtttgttttctatgatataaggatattggtgggagtcgatttcgatctcaaggtattcggaggtagattgagtgacaataccttgcgcagttaatgggatttcccaatcgacggagaaattctttaaagtaatgttccggcaatgatccaaagtgaatggttgcatccgtccatgcataataaactcagaaccattaccgtcaatcgtcagatcattgatctgctccaatagcacggcgagaattttgggattaacatcgtaggtgttcgtttcgtaataatctttttcgatagcatgttgtgcccagaagtcatatcttccttttgggaaaacaagcgtggaaccgggatgttgcttgcaagcatcgattgccttttgtataaatggaactgcgttgatacggctgtcgggtttcaaaccgaaatcagatacggaaataatcttgcttgctgcaatgctgtttacgcaaagtaaaagtgcagatagtaagcatgtctttaatgataggaatgttctcatgtgtttttttatagtttaattggggtaaataggtaaaatctaatgtttgtgttttttccagacacctctggtgaaatccggtatttctacaggaatacttccgttcaatactgacttctcgcttaattcggtgatacacgaccattcggctgcatcataaacgtccatgtcaaggggcagtccgttgcgcaggcaatatattaaccgataatccattacatagttcatttcgttcggtaatcctttacgatgtgcttcctcgccgatggtggcgctaaaagggtgtttatagcgagttaatactgtctccagtgcttcgccttcaagcggagtatctccatgagaatccagggcaatgcatggtaccggatatttttgtgcaaagccgagtgtaccgcatactgtttgcaggcgactgtaagggcggggagtagaaacattatactgaagcatgatcgtttttcctttggcggtatggataagcgtggtgttgacatctcccagcttatacttctgacgggcttccggtgagttctctccgaatcttttccgcgcatactcgctcatgccggcctgatgggtggacatggatacgagatattccattctgtcattgcggtggatgtcgagaatctgacatgcaggtcccagtccgtgggtggggtagggattgcctgtatgttcgatactgtatctttttccccagtgattgtggtaaccgccttcgctctcttcggcaaaatacatggaacggagatcgtgaatatacgctccttctacatgcattatttctccgagtacaccttgacgtgccatttcgagagtagtcagggcaaaagggtcataacagcaattttccagcatgatacagtggcgtcttgtcttttctgctgtatcgaccagttgccagcattcggctatattcatggcggcaggaacttcgatagctacatgtttgccgcattccattgcataggttgccattggggtgtgagtgagccagtctgtacagataaaaattaaatccagatcgttgcattcacacatctttcgccagccgcctggtccggtatatcccgtggcttcggggtgctttgcttctttgagtatgagttgggctttgttcaagttaccttccctgatttcgctgagagctttgatttcggttccttctatttgcagataacgttgcagggtgagtagccctcgattccccaatcctatgattccgatgcggacaattgggataggggggtgtgccaattgcagtacgtgtgattgcgttggagaatcttccatgttcttagaggtttaaagttatacaaaaaagagaatctaatttctcagattctctttgaagagcggaagacggggctcaaacccgcgaccctcagcttggaaggctaatgctctatcaactgagctacttccgcaatttttgtgggcaaagatggattcgaaccaccgaaggcgtaagccagcagatttacagtctgccccatttggccactctggtatttgcccttttgtgcttttgaggaggtttgtttctcaattgcggtgcaaagatacaactatttatttaaactccaaacaaaatcgatcatttttattgcagaaattgcacattcatctcctttgttacccagtttgccaccggcacgatcctctgcttgctccattgtattggtggtaattaatccgtaaatgactggtatgtcgccagttgcgtttaattcggtaattccttgagtcgctcccatacaaacataatcaaaatgtggagtatctcctttaattacacaaccgattgcaataattgcatccacatcgcaattttccatcatttgattggcgccgaaagttagttcgaaacttcccggtacagtttttaccagaatattttcatctttcactccatgtttttttaatgtattgactgcgccgttcaataaggctccggtaatattgaaattccattcggatacgacgatgccgaatttcatgttttcagcgtttggtacagagttgaaatcgtattcggataagttatggtatgctgttgccataattgtagtaattaaagtgggttataaatacatgattttaaaaaggcacggattacacggatttcacggtagcttcgcataattgcattagtacatattgccgctacgctgttgacgagacaggatttcaatgaattcttctttactcattttttgcatagtcttttttctggcaaagatcgagacttaaagatacaaagacaacgggtactttatcgggggcttacattgttatctgtattgaaaacttgtttttctttcactatattgaatctcttgcttttttcgttcaagctattcaactgtaagctcccgataaagtcctcgtataaattatagaatcgctatatacatctaataagtttatagcgattctctgtttataatatgcttttcattagagtattgttagatttctttggatcttctcagtttccagtaattgggtagcaactcttttaggtcttttcccttatcccttgtgtaatatggcaaccaggcaattatttcggtaagccattctctagggttaacttgagatgctttacatgatgccaataatgaacagatgacatctgtgttttccgccgcttcatgatttccacaaaacaagaagttttttctcgataaagctattgggcggattgcattttcagccagattattatcaattttgagcttgccgtctttgaggtaatttctcatgcgtggccaaagggtataggcataggcaatggcttgtcccatctggcttttaggaagcactttcggataggttgtttccatccattgttccagctcgtcaagaataggaagagcctgtttctgcctttttgacattcgcatttcaggggatattccctgtatgtcggccgcctgctctatccggtagagttcctgtattttggccagaacgtacttagcctgagacttattttcctctttggcggtctcatagtgacgcctgatatggacaaggcaacccacaaggcacaccctttccttaccttcaaagacgttgtaggccgcataaccgtcactttgaagatatcctttaaatggttccaataagttccgtgccgtttcctgtgaacgggaaccgtcatcataatgaaagaatactaatccgctggttaccgccctgaccatccacagatattccctgacagctttgtggctttgcttgttgatgataggcaatgtggtttcatccacctggatgtaatcgactgccaatacctgcttcttgagttcatcatacaaaggctttagcagctcacaggcgggtttgaaccagccatgaagcgtgttttccgggattttcaaacctaagtgatggaactcccgtatctgacggtagaatggaacgtgatactcatacttttgcaggagaatttctgccagcagactggcacccggaagtcccttataaataggcaacagtggaagatcggctattacgataccatcctgatattcctggggtaaagcggtattgtctttcagtccatatttgggacgtatgatttcctttacatataatttacccggttcaaactcaagtgtacgtgtatgttcctcgccaatccgtttatactttgtaagatccaggtcttgcggttctatgacaacttccacaaccggaagtccttccaacagtttacggttctgccgttctttctttttagtaaccataggtgttgtagtttgttcaactacagtttcttccaaaggttccggttctaaggattggaccggctgttcaaacagggatagctgatttgggtctagacgggataacttttcactcttacgaccaaaaagttgtcggttcagccatgctacctgagccagcagttcatccagtttgttttgtaactgttcattctgccgggtcagctgtctgatggactcagactgactggcgttagtctgttggagtgtggctaccaaaagttctaatgtttctgtccgagtcattatttatgaggattttgaacaatacaaaaataagaaaaaactcttacttaaacaaggtctggtccattgagtttcactgttatatatcactttttcgtaacgccttcaatcgcttgagcctcttagcggatccgttattgattcctttcaccatcatgaccagatcacgccactccatggggtatgatctgctttgctgatcatattcgggcaagcggaaggttccttcctccagcctttttatatacaagacaagatcgccatcttccgcatgcagaagtttcatcgtggtccgctgccggtttatgaaaatgaatacgtcacctaaacggacgtcgtagcccatcttgttatgaatgactccacataatgaattcatgcctttgcgcatatctgtcttacccgggcaaaggaaatatcgcatcgtatcattcaggcaaaacatgatgaccgtaaatttgagtgagtaattgcatggcggcatgggattcagccataccactgaagcgggctattatgccaccaggaaactctatttgaatctccccggatcccatagctactctatcataagacgggttggatgtggacggggaggtcaaattgataggagcgaactctccggaagaggatctttccccatgataaggtcgtgagagaccaaactttcctttccaataataaaaactagattcggtataggcttcattgacacagaagtcttttatcgtcaaaccgcttcgttgctgacgggatagaatttctaagaattcttctttgctcatttttcgcataatcttttttacgcaaagatcgagcgaaaaaagatactagacaacgggtactttatcgggggcttaccattttataatagattcaggaatttgtcatcttttgcgaatccgttgttaatccagtaggtggacgattccggcataatcggcgggaatatcatcgatgctgtaattgggcaataccatgaacccaccgcatgacacaacgggagcttttgtcaccgacactgttttaaccacgtacttactctcgatatcaggtccacaaccgtaattcaggtagggagcaatgtacgctccttcccaatcggcaaagtctttgagtagtacaaatagaatctcttgtttcattattcgttgtattttagataatttattttaatcatttataccatgtttatacgggcagacatttcggcattgccagcaacgaagttccaatacaccttttacggtaatatagcaaactttccggcatcctttttgactaaaattgttttcgtctgtgagtgctcccgaaggacaaagatcgacgcataggttgcagttgttgcaaacctggtatgtcgccaatggatcgggctctaattccaacgaggttactactgccgtaaaccaaagcagattcccgtacttatcattggtaagcaggtagttgcgagctataactccaagcccggcaagttcggcagcatgtttaagtgacacacgcgagcggaaatgtccatctacgaatttaccgctaagcgagactatcgacacggctttgtatttgagtcctttgagttcggctgctacatccgcagcaaccttatccatctttttaactgcctcattgcgtatatccgtatatgttcgtatatcctgttcgagaatatctttgggcaaaaccattccaagagagatgaccgacttagccgttggcataacatcggttgggtgatatcctttcggagcatttacaaaccgctcgaccgaggcaactcccaccagatcagctccaaacgagcgacataactttttaatctctttatttgtcattttttgcagttgtattatatcaaataatccccagtgctattgcgataaaactaggaccattgattaccccatgtagaaatactcctgtccatgtgttctgtgtcttttgtaccacataaggctctatatacaatagcggtaataacataacaagtagttgccaaccaaacgctatatgaaaaatagcccaaccagtgccatgtaatatccacgttttgtcttcgaaagtcttttcttgccgaggtaacaacacacctctccaaaagaactcttcgcctccgatattgagcaaccaatatgggaaccatgcaagcaatagccaatatcttcccggtgaaagcggatccaaagtcataaacgacggagtatggttgaaatccgaaaaaaggacttgcatcgcaatcataattccacttgtcaagagtccgattaccaccaacgccagaagtgaataacgccaatctctacgactcataggtctgaatcgtagtcgctccacaaaggtctcttttgtgaatttgcccccttctttgcgaagcgtcatcacgccggcaataataagtggagtgaaaactccaagccctccgcaaataaaccagaagataatggactccaatccggcaacttccgaaagaaacggaatgcataagtgggtcatcacccccaaaaagcatggctgccgatacgaatatcagtgtcgatggcattaatctcaatggtttcatttgtattctattgcttattatttacaaaatttcttatattcaatcgacagaatgtttggcaaagaataatcctttccgattcaaatccaatttcttcatttggagaataatacaagtctcttcgaaaggaacgataatcaagaatggtaatataaaccataggaaagagaagctacccataaaaatataaataaaaggaatacagtatattaattagaaataatatcttttttgtttgcatgttttccaaaatatgtccatatttgcagcgtgttttcttgccgttacctaagaagtaacaccatatttatcagcaacttatcttcaaaaacgtttttctaaagggagagagaaccgttgcattagcctcatcaattttcttattcttaaaaggtttcagataagtctctgttactgtgatagatgaatgtcccatagcttctgaaatgataccgggatgcacttcactataatatgccatcgtagcccatgtatgacgggcagtataagtaatatttagaaatgcagtaaaaaacggaatggcgagtataaaacgtaaaacgtttataattaagcactttacgagaattgcagaataggctggcctgcaaaagaaaacaaaatattgcagcgtttcagttaccaggctgttagccgcctgtttctgaaacgacgacaggtaaccgatttttatcgataagaacaaagcggatttgtattcactgttcatcaatattttgcatgccaaagggcgcttttcaaaggagtatttttacaacctaaaaaagagcgttatgaaagtggaaaaatttaaggtactgctctacctgaaaaagagcgagccggacaagaacggcaaagccccgatcatgggacggatcaccctcaaccgcacgatggcgcagttcagctgcaagctatcctgtacccctgagctatggaacgcacgtgagagtcggctgaacggcaaaagccggaaagcggtggaaaccaatgaaaaaatagagaggctactgcttgccgtacactcggccttcaattccctcatggaaaggaaaaaggacttcgatgccgccgcggtcagggacatgtttcagggtaatgcgggcatacagatgaccctgctcaagcttctcgaccgacacaatggggaaatgaaggcccgtgttggcgtagaccgtgcgcccaccacactctcgacctacctcttcacctaccgcacgctttccgaattcatcaaggcgaagttcaaggtctcggacctggcattcgggcaactcaacgagcagttcatccgcgactatcaggatttcatcctcatggaaaaaggacatgccgtggacacgcttcgcggctacctggccatcctgaaaaagatctgccgtatcgcctacaaggagggacattcggagaaataccatttctgccacttcaaactacccaaacagaaggaaagtacaccgaaagcactcagccgggagaatttcgagaaactgcgtgatctggagattccagagaaacgcaggtcgcatgtcatcacccgggacctcttcctcttcgcctgctacaccggcacagcctatgctgatgtggtaagtatcactcgggagaacctcttcacggatgaagaaaacaatctctggctgaagtaccggaggaagaagaccaactacctcgggcgcgtcaagctgctgccggaagccctcgtgctgatcgaaaagtaccgtgatgatgcccgcatgaccctctttccaccgcaggactaccatacgctcagggccaatatgaaatccctgcgcctgatggcaggactcagccaggaccttgtctaccatacagcaaggcattccttcgcttctctgatcacactcgaggagggagtgccgatcgagaccatcagcaagatgctgggacactccaacataaagaccacccaaatctacgcccgtgtaaccccgaagagactgttcgaagacatggacaggttcattgaggcgacacgtgatctcaaactaattctttaatcctaaaaacgtcattaccatgcgcagtacattcagactcatgttctacatcaaccgtaacaaggtgaaatcggacggaacgacagccatcctctgccggatcagcatcgacggcaggaagtcagctgtcacgacaggcatctattgcaagcccagtgactgggacagtaacaaaggagaaatcaggatgaacaaagaaaacaaccgccttaccgctttccgcagccgactggaagaggcatacgggaacctgctgaagaaccagggagtggtcacggcggaattactcaaagctaccgtatcaaataccgtttccattccggaattcctgctgcagaccggagaggcagaacgggaacggcttagaatccgttcagtcgagattaactccacctcaacttatcgccagtcaaagacaacccagctcaatctgaggcagttcatcgaatccagggggatgagggacatcgccttttcagacatcaccgaggagttcgccgaatccttcaaaatctttctcaagaaagagctgggacatgggaacggacatgtgaaccactgcctgtgctggcttaacaggctcatctatatcgctgtggaccgggaagtattgagagccaatccgatagaggacgtggcatacgagaagaaggacagtccgaaattgaagcacatcgggcgcaatgagttgaaactgataatggagaccccgatgcccgacccgatgatggagctggcacgcaggacattcatattctcctctttcacagggcttgcctatgtggatacgcgcagactccatccacgccacattgaaaagagttccctaggaagaagatacatccgcatccgccgggctaagacgggcgcagaagcatttatcccgttacacccggtagccgaacaaatactagaactttacaacaccacggataacgagaagccggtctttccgttaccggtccgggatatcctctggtacgaggtccacgggctgggtgtagcactggggatgaaggaaaatttatcctatcatatggctaggcattcgttcggaactctaatgatgacctccggtattccgatagaaagcatcgccaagatgatgggacacacaaacatcaatagcacgcaggtatatgcgcaagtcactgaccagaaaatatcctcggacatggattggctcatgaaaagaagaaagcggaaggatacggactgggttaagagctaaaaatgtccagataaaaaatgggatgagtgtcggaatccttgacagtcccaacactcatcccattaaagcctaaaaagggcaatattatatcagcgccctgtgatagttaccttccaataatttttcaatgtccgacgttttatacagcacctttccacccagttggacataggggagccgaccctggtcacgataatcctgcagacatctgcgactgattttcaacagcccggacaactccctgtcagtcaggaaccgttcaccgttaaaaggcgggcggttaccctccattagctgatccatttttacctgaatattctccagcagaataaagaaacgcaggatactctcactctccttaccgataattccttccatttcttgcttttttaaaagttattgctttttcttctgtctctcaccgccttctccttgcgcctcataccgacataagtcatcagcctctccacatcttccggtttgtaataaaatttacgctgaacctgggtgaacgccaaccgtccggtatcacgaagggtctgcagggtacgggaagaaatgtcaaggcgcaggcagacatcctgaccgtccagtcactcaccaacccctttattcgcatttttctcatacagcctgtccacgcgtgtcgatagactttcgacacatcccagcatcctgtcaaagataccggcttcaatgtaatatatttccatatgatcgattttaaatattcgttgatgcgaatgtaagagaaaaaacgatacctgccaaactggaccggactgatggcaggaatagtcatggatagtcagcaattgtcaggagatgaaaagatatttataaaggggtatctgaatccgctatacccatccgaagaatgtgtcactcatgagcccgttgtgttctatataagggaaaaaaatcctgccaaacgggcatttcccaacccataggcggactacctgagtacgtaaaggatatgagcaatacctagagcattcggttctcccgtttttatttggcgatgaatgagggagaatcacgtttcttcggcaatcagggatattttccattgtactatcggatgcttcacaactcgtgagagaatagaagtctcaattcatagattttctttgcgaaacttgttttctgttaaaagcaaaatatattccagaatatacaactttcattcaggaatatattttgaggtatatttatccataagataatgtacgcctttacccatttttcctcgtatatcaaagaagccttcacccagtaggcctatccacttcttaaaaaatggcagtacaaaatctataccttttgatacatgcctgacttactatataatggcaggtgatgcagaagtatactttcattcgtttagtccatcagttcaaaataattaagtagttccttcatattgccgacaaaatacagccagtcgatacaataaactttattgcactcaaaaacgatcggatattcgtatttgccgacaactgtactaccccttcttggtactgagacatatatgtatttaacggaagcaaaattcaatcgtttgagatagtatacctgtatattactatttattttagaaactaatattggatatttaagtcgacatcaaaacgtcttaaaagtggaaaataagatagcttaaaaaataaaataaaaaaaagtatgttatacctgtcccttttcgattacctcagttgtactattagtgtaattgcaattaaaagataagattttgaaagagaatatggaaaatatgaatccggaatcattgctccgaaaagcgcaggcattaggagaggatattaaggaaatggagtctattgatgtaatgggtgcctatcaacaagcacagacccaaataaagacaaacagaagaaggagtatgtataatcagttgatgcgttatgctgcattcttgactatacctttattactttcttctttgattttgggatatttatattggggagcaacggatactgaagagaagtatgcagaagtcatggcggctacaggttcagtcattcgttacgaacttcctgaccattcggttgtctggttaaactccggtagtactttacgttatcctaccgtttttaagaaagataatcgtaatgttgaattaaaaggtgaagcctattttgaagtagaagcggacaggaaacggcctttttacgtcaatactcctgccgggttaagtgtctatgtgtacggaaccaaatttaatgtgaatgcttacgaagatgataatagtatagaaacggtattagaaaagggtaaagtaaacgttatttcaccggacggaaaaacaacagttcagttagctccaggagaacgattgctttataataaggtagatcagaaattgttgaagggaaaagtggatgtttatgaaaaggtggcatggaaagacggtaagttgatattccgcaatgccgagttgggtgaaatattcaaacggctggcacggcattttaatgtagatattcagtttaataatatatcgggaaaagaatataaatatcgtgcgaccttccgtaatgaaacactgccacagatattggattatctggctaagtctgctgccttgaagtggagaactgaggaggcggtacaacaggcagatgatacattcacaaagaaaaagataatagtagatttatattagtaaccataaaaatgagaatagcctatgagataacacaaagatcgtaaaaaaaggaagaaagctgctaccaacagctgtcttcccccaatttttcagattcgcggtaaggagtcttgcaaacgctaaccggaatcaaaccacagttcattatagtaataaactttagttaaccgcaaatgtatgaaaaaaaatcattcatttattgcattatatcctaaatatgctttaaatctaaaactacctttagttatgaggattagtctggcactactttttgcagtcgttttacaactatctgcagagaatggctatgctcaacggacgcatgttgccatttctatgaacaatgtatctgtagaacaggtactgaataaaatagaagaagcttccgattatgttttcctttacaatgacaaaacgattcagaagaatcgtattgtttctgtgagaaataaatcaggtaagattctggatattctagatgatatttttaaggggaccgatattacgtataccgtagttgacaagcagattattttatcgactaataaaatgcaacttgttcagcaggaaggacaaatccaaataaaaggagttgtgaaagatgctggcggagatcccttgatcggtgtgaatgtgaaagtgaaagattctacggtcggtactatcaccgatataaacggaaactttacgctacagaccaggaaaggagatattctggaaatttcttatgtgggatatgccacgaaaacagtaaaggtacagaatgcccaagttctgaatattgtgctgacagaagatacagaagtactgaatgaagtcgttgttactgcattgggtatcaagaaggaagctaaatctttgtcatacaatgtacagcaagtaagcaatgccgagattacacgcattgcagatgccaacttcgtcaataatctgaacggtaaagttgcgggtgttacaattaactcatcttcagctggtgtcggtggctcttcacgtgtagtgatgcgtggaaccaaatcattgaatggtaataacaatgctctttatgtggttgatggtatcccgatgagtgatatgagtgccgcttctacacagcctacggactcatacgaaggtgccggtcagtccggtgatcctatttccggtctgaatcccgaggatatagagagtatctctgttttgagtggaccgtcagctgcagctctttacggtagtgccgctgccaatggtgttgtgatgattactactaaaaaaggtagggaaggacgtacttcagtcagcatatccaataatacgactttctccgctcctcttgtcttgcccgaatttcaaaatacttatgggcagacagaagtgggtagttactacagctggggcagtaaattgaatacgctgagcagctatgatcctaaagacttctttcagacaggtgtgaatgtaacaaatgctgccagtctttctacaggtactgacaagaatcagacttacttatctttaggtactaccaatgccaaaggtattatccataataatgactacgaacgttacaatgtcactgtccgtaatgttgccaagatgctgaaagataagctgactcttgacctgagttttatgcttagctctgtaaaagaacaaaatatgacctctcagggactttattataacccgttagtacctctttatctatttcctgcgggagatgatttctccaaagtacaggcatatcagcggtatgattcggaacgaaatttactgactcagtactggccttacagcacaagtctggctttacagaatccatactggattaccgagcatattaaaatacctaatcataagaaccgttatatggcaactgcatcggcaaaatatgaatttgctgactggattaatgtaacagcccgtgccaaaatggaccgcaacaacgaacgccgtgagcgcatgtatgatgccggaacaaatactttgtttgcttctaaatacggttattactccaagagtaatatcgagaatcaacagatatacggtgaattattgctgaatattaataagtactttgtcgataataccctaaatgtaacagctaatgtgggtgggaactttgaaaacaatgattatcagtctgattatttcggaggcaaactgaagtcggtagccaacctctttacttttggcaacgtggatacttcagagaagaatctggccaaccaatatggctatcatttgaaaaaacgcgccatattcggtagtgctcagatcggttacaagtctatggcttatctggatgtgacggctcgtaacgactggtcatctaccttcaaagggacgaataccggttctttcttctatccgtctatcggtctttcggggattatcacagatatattccgttgcagtacggatattatgccatacatgaaagtacgtatttcttattcggaagtaggtaattcaccggatgtatttctggctattccgacttatgcgttggttgatggcgttcctgttactcagtcccgacgtcctaaccccaatctgaagccggaacgtaccaaatcatgggaagccggatttaactttgtcttcttcaagaaccgtttgagattggatggatctatctatcagtcacgtacctacaatcagttctttgaacgtaccctttcttctactaccggctataaatcggaagtagtcaatggcggtcgtgtagataataaaggtatcgaattgtctttgcgctttgaggacaaatggggaaattttggctggagttcgtatctgacctattcattgaaccgaaataaagtggtggaattgctgcgcaactatgaagatccttatacgcacgaacttacttctttggatagaattgatatgggcgggacaagtatgtataaaatgatactgacagaaggcggatctatcggcgatatttatgtgaatacgcttcgcacggacgaacatggagctatctatgtccatccttcggaccaggttgtagttactcagcctgatgaatttgtaaaggctggtaatagtgctcctaagtataacctcggttggggaaacacattcagttacaaagggctttcattgggattcctgttcacggcacgtgtcggtggtgtagttgtatcacagacacaggcgacgatggacgcatacggctcttcaaaggctacagctattgcccgtgataatggcggagccattgttaacggtcgtccaatcggtgcggaagattactatacgaaaattggaggtgcaggtgctcagggtggtattggttctatgtacacctacagtgcgactaatgtccgtttggctgagttatcgttaggctatgatattcctatcaacaagtatgtggactggattaaggggttgaacgtatctttcatcggtaagaatctctttttcctttatagaaaagctccgttcgatccggaactgacagcaagtacaggcacttactttcaaggtatcgacatgtttatgtcgccaagtctgcgtaatttgggattctctgtgaaagttaatttctaatcaaacttataaattgtagaagatatgatattaaataaaatactatcatggaacaaactttccattctcgggatatctttgatgctattaaataacatttcgtgtatcgactatgaggatgtattataactttttgttatagccacttctcttattgttacattatgctcctacgatgtcctttccaaatggtgataatgctaacgcagccaacttaaagtgctgcaaaccaaagggtatcccaatgatggtgatacataggacagctccaaaaaccagatgtgacaaacaaatccaaataccacccaaaaatatccataaaacattcatcagtatataaaggcatccgcttgaacgcccaccactccttacttcttttccaaaaggccacaaagcaagtcctgccaacttcaatgtttgcataccgaaaggtatacctacaattgtaagcatcatcaatatacttgagattaaatactccactgccgtaaaaataccgccaagcaataaccataacaaattcattaaacagcccataagtatcagttctaatatttatttagtattttctttgttgtctcatccagcctgccttgaaaatacagatcaattaccttttgaaataaatcatcagaagcaacttcattaaaaagtgtcatacacgacagcactttcattgcgtccaatcctccgaatacatctaccgcagtcttacctttcagttgcaaaaatactgttgttatttcacggagtctcactcccaaaatgggatgagcaagatatgcttcggcctcctctttaccacaaattccataatactgagaattatagctcattcccagtccttttaactgaggaaatatgtaccaaatccaatgagaatattttttcccatttttcacttctgcaagtgcttggttataaacaccttgctgggcatctagaaaacgctgtaatttataatctaccatatatatcttctcataccacattcttgatgtatacaaagatatgtgtattttgcatataattgatagattattctaaaaaagaacacgaatcaatcctttagcaatctaaagatatctttggattactaaaggattaatggaagaaatgtaattctgaaataaaaattactctttaacaggtctaattgccattttaatcatacttgcattccaactagcattataataataacttgtagaattataatagaaaacatagccaaaacgtccataagtatcaccgtaagattctccaacccaataataaccactattctcgtccactagctgtgtagctcctgccggtccacttgccggaagcatataacccgtagagggtaaaaagatgctatttccgttactacctgttactttcataccactgactccgtttattgttgctcttgtccatgtacatttcttaatcaaatctatttgctcagccttattgggcaatctccatgagcctccccacattgcacgtgctatgtcatatttgcttccacagatattatcaatattaggagcctgataatcaggcataactcctacattatcaacatctccccatagaaaatagccacctttctccgaagatgttattgctcccaaattaaatgaagcccacctcacactaagtcctaaatttacagctttataaagtgattgttctcccaaaggaataactatttctgttccatctttgagtattaatctgagttcatcttccgttgcctctacagattcaaaaaatgaatcaccatccattccagaagctttaactgccttcccgtattcgtcaagcaatttggaataagtataacctttatcatagcttatgatccaatatccatcagagtctactttcaatagtggcgtgatagcatccgttcctgatgcaggaatcttgtttccatcactatcattaagccatgttgtttcaccattaatagtttgtacccaatagtatctaccgttataataacggacattgattacgggagcatcttttccattaatcccatcttttccatctgaaaccgtgatatgcgaaccatctgaaaatgtgagtgtatagccatctcccaatgtagtaacattggttagatataacctattttgaagtgcccctactaaagcactaatcgatgtgatatcattattcaatgctttcaattggttctcaatagaggtcactctgtcatctaaagaattaactctatcccataattcgctgtcatcgtattcgttacacgcagttgtgcacattaataacagcacaaactgataaataaatctaaatgttttcatttttttatttttaatccaaacttagaatcgaagatttcgactatctgatttttatgagtatattttatctattatccaaatacttatttgccgttttagtctattgtgcagcaatacttaccttaaaatatccatcagggaaattctgtatgtaatccccactaaagtagaactgcacatatgctacatctcctgagccaacatatctcaacataggatcataaatttgaccagttcctgtaagtgataatgttccactaccggtaagcttataatttgaatcatacacctcataacgcaatcgcttgctatagtttacatcattaaaactaccaagatactctaaatttatatgcatataggtggatttcctattgaacttgaacacatccacatctctagtagaagacaatgagaatttcattgactgcccatccttgatggtgtttgcgttagagaaattattgttatactcactctctatatattctggtattacatttacatagactctctcatttccgctacttaaacgtgttatgtatcctgttggtttaattccaactatacctattttcaatcctgtagcagtcccatctgcatcaatagaaattactgatggttcagaaacaacatttacaggttcatagaatacaaaatcactcagattgccaaaaatattcaacacagaactaccttgcttagaagtatagctgattttctgagattctcctacggccaaagttaacataggataaatagagtaagtctcacctgtattactccaagagaaatcagatattcgagaatgaacagtatattctttagatactccactatttttatctttaacaacaacatttgcttctccataacctacaattttaacagttgcattgccaccactaccactgactgtcaagactctgatatcagaagaactccattcataatccgttacagcatcacttggtttacaagtgacaaaaaagttataactatcacctacataagcatataatgttccattgaacagtatatcaagagcagtaactttcactaccgttgcctgtatgacggttactgtttccgtcttctttccatccgaagaagtaaaagttatcttgccagtacggctcttacctgtcgtattggacattatattaaatttcttcatactgtttgatatagagcgtgtaggtatttctgtaatccaatcattagaaattgacacaccatagtcgatattactcttcagttgaacgttaatgcttgtagtattcccatcaatattataagaagactgagtaagtacaagaattgcgccaccactctgataaaccttcagagtatcactgatgtcgttgtatttgaaatagatttcaccttcacgcttatcatattcatcactgcttgctacagaaaatgcagatgttgtttttgataatccacgatgaacattaactgaagagttagccctactaatccagctgttgcatgaaggaggaatttcaatagagtactcaacattactattaacatcaacaaaaaatgttccaccattttgggggacttcaaccttgttgtttgaaagcagtatagcatccttctgattttgcttaatggaaacactttctttcttgtttccgttggcatctttgaatactataacagcctcacggtcagcatatgtgttatttgcacttatctcatagacaagagtatggcttgaaactgcacgagataaatttgcagattgaatccaatcaacattaggcatatctatttcatattcaaagttgctgctgatgtcaattgatgcccgtccaccatcacagccaaaagtatattcattttgagaaagaataagaatagcagaacccgtctgatacacctttactgtttcatccgattcgccggaagtgataatgatttctccttcacgtttatcatattcttcacttggggatattgcaaaagaataaaagctagtagacaagccacgtgtacgttcagaaataactggttcaatccaagtcctgctattttcagcaacagtcacattataatcaatatttgactttacctgtaaattaataattcccccatctttatcaacctcaaatcgattcgatgtcaatgttaaagcatctttttgtttctgattgatcatgatgcttttagttaattcatcaacactgagctttaaaacaacattcctgtcatcatatccagtattactagccaccacaatagttaatgtgacatttccagctttaccactcgaaggagacactgtacaccaattatccccattctgcgtctcggcaagggaaactgaccagtccttgttagtggaaaaagaaattgtagcccgttcaccttctgatgagacattgattccttgactaaaaattgtctcacattcagatgtaggtacgatttctgtttctactctaacttcattcttttcgttctcttcaccgcatgaaaacaaaaagacaagacataaacacattaataataatgttattcgactaattttaaatttacggttcatattatattactttaaaataaactctgctgatgagattccatatctttctccagtttctgataataaatctcattaatagaatcaaatcctaaacgcaatccaactacccgactgtcgtagccgccattaatttcgaccgcaccgggacaacaaaaatcggtaaatatgtgttgaatcattcgtttatgatgcccggactggtatctaccgtagtcgctattgttttaggactgctctttattcaaatattctaatatattattaacctaaactcatttcagttatgaaacaaattaagaaattaggcctggtagtagtaacactactattatccgcaacaatggcatttgccgcaaaaccgaatatccacatccttgctaccggaggaaccattgccggaacaggaagctcggctacgggcaccagctatacggcaggacaagttgctatcggtgcattgctggatgcagtccccgaaatcaaagatatcgccaatgtaaccggcgaacagattgtgagaatcggttcacaggacatgaatgacgaagtctggctgacacttgccaagaaaatcaacgagttattgaaacgaccggatatcgacggaatcgtgatcactcatggaacggatacgatggaagaaactgcttactttctgaatctgactgtcaaaagtgacaagcctgttgtattggtaggtgccatgcgcccctctacagcattaagtgccgacggtccgctgaatctttataatgcagtagttaccgctgcagctaaagaatcaaaagacaaaggtgtactggttgccatgaacggtctgattctaggtgcagaaagcgtagttaaaatgaacacggtcgatgtacagactttccaggctcccaactccggcgcattgggatatgtactgaacggtaaagtatgttataatcagatcacactgaagaaacataccacccaatccgtatttgatgtcaccaaactgacttcattgcccaaagtcggcatcgtatacagctattccaatattgaagccgatatgatgactccgttgctcaacaacggatataaaggaatcattcatgcaggagtcggaaacggtaatatccataaaaacatatttccgtcattgatagacgcccgcagaaaaggcattgtagtcgttcgttcttcccgcgtaccgactggtcctaccactcttgatgcggaagtggatgacgccaagtatcagtttgtagcctctcaagaattgaatccacaaaagtcacgtgtactattgatgcttgcgctgaccaaaaccacggactggaaacaaattcaggaatactttaacgaatactaaaaaccggacctacttatgaaaaaattaatgtttatgctactccttgcgggtagcatacaggcaatgtatgcccaaaagttctccccaaacactcctcttttcgaggaactgacagacgtaaaaaagaaaacggataagttcaacttatacctgaatatgcaggggagttttgacgctcatttccagaatggatttcaggaaggtgacttcaatatgcaccagctccgcatcgaagcgaaaggaaatatcaacaactggctttcttatcgttaccgccagcgtctcaaccgctcgaacgacggaaacaatatgatagacaacctcccgacctccatcgactgggcaggcatcggtatcaagctcaacgataagttcaacctgtttgccggtaaacaaagtgccaactatggcggcttcgagtttgacctcaacccgatcgatgtctatcaatattgtgatatgatcgattatatgagtaacttcctgaccggtctgaatgcaagttataacattactcccgatcagcaacttaatctgcagatattgaacagccgcaatagctctttcgacaacacttacggaatcacagaggatgcggagggtaatctccccgatctgaaatccggaaaaatgccgctggtctataccttaaactggattggcaattttaataatgtatttaaaacccgctggtcggcctctgtgatgaacgaagccaaagatcataatatgtattattatgccgtaggaaatgaactgaatctcggaaagtggaacgccttcgtcgacttcatgtactcaaaagaagagattgaccgtaaagggattatcacaagcatcgtcggtcgtccgggcggacacaatgcgtttgatacaggttatttatccgtagtagccaagtgtaactatcgttttcttccgaaatggaatgcctttgtgaaaggaatgtatgaaacggcttctgtgaccaaagcctccgaaggaatagaaaaaggaaattaccgcacctcctggggatatctggcaggcatcgaattttatccgatggaaactaacctgcatttcttcgtgacctatgtaggacgttcttatgacttcacctcccgtgccaaagtgctgggacaagagaattacagtaccaaccggatttcggtaggattcatctggcagatgccggtcttttaatattgcatgagaataaaaaatacccgatagctgtgtgaaagttatcgggtatttttatatgttcggtttctttttctaaatcaatactcttcctcgttaaaaaagaaatcttctttactaggataatccggccaaatatcttcgatactctcatagatttcgccttcatcttccatctcttgcagattctctatcacttcaagaggagcacccgaacgcatagcgtaatcaatcaattcgtccttggttgccggccagggagcatcttccagtttcgatgctaattccaatgtccaatacataatcttgagtattaaaaagtgaatacttattttctatttttcggcaaaagtataataaaatctatcatttccaactattatcccagaatatttcactattttgttcatcaaaattaatttttcgggataaaacaaacaaataatctgataatctgttgacaaaagctaacacttcaggagaaattgtacaagtttcggacagagtcagaatgcgacgttcggctctccggcaaatcgtacggcacacatgacaaacagccgctccacggctgcctccgggtatgataaaggcacaaagttcgggcaactgttcgtccagcttatcaatctcgcgctcgatgcgttccacatcttccggagtaaggatactggcggctttcagttgtgttttttcctggtctgttgccaaatgcgaaccgatagagaatagcttatgctgtatactcaggataaaatcccggtctgcctcatccagcaaatacgtattcagccatcccagatgggaattaagttcgtcaattgttccgtatgcttccaaacgaatatgggtcttcggaacgcggcttccgccgacaagactggtagttcctttgtcaccggtctttgtatatacaaggctttttttcataaacgtctatttttcatcattactatatataagattaacgtataaaggtgatcagaagttgacgatataatgctgtttaatctttgttgtatcaaaaaaaagcaagcctgcatcatacaagtcaaaagtgattcccacccgctcatcattctgtaactgtttccaaagatttttcattgcctttgaatagcagatcccatgaacgacaaacaaactattcggagtagtccgacgggaacagatgttaaaaacttcttccagcaaagccggattccgatagtcattcagatacagaaagtctaccggagtatcggcatccagaaagagctctgataagtcagaagcaaaaagatacccggcagaaggtttggctgactgtaaatataaagaggctgccgagggctggcctacttctatgatagtggccggttgcactttattcaccaggcggaacaacagacggttgattcttggtattcctttctcccatctctgtgttgtgatccgctttttctgttccaccttcagcaggtcgtatgcataataaggcatcttctcataaatcacatctgtgatcagactgaaagcaaaaggagagtgcacaccatatccacaacggtagcggaaacgggagagccggataaaaggtctttttaggtaatacagaagattcataaaccagtctttcattttttttgttcgtgacgcaaagatatattattttattgaaaaaagggccggctcccgcgatggaccgacccttttaatcatttatttcaagtaactactgcagtctgaatactacaggtacagtatattttactcgaactttcttaccgttctgcactccgggcttccactttggcattccacttatcacacggatagcttctttatccaggtaagcatctacccctcgtacaactgtcggattagtaatcgatccgtctttgtctacgacaaactgaacaattacacgtccttgtgagcccatctcctgagacattgtcggatatttgatatgagtactcaaatatttcagcaattcagctgaaccaccgggaaattcgggcatgacttctacacttacgtgaataacatcttcctcaacttctttagtttccactactggcggtacccaaacaaccttgtaaggttcattcacattgtctggtactactgaaacgttatccgtcacctcttcggtatcatctactatttcgaacaattctgttactttagtttccggtggaggaggcggttccagtttctcttcagggaatgtgattggaacgagctccgttacaaagatggattcatcatcagatgatactgccgcaactcttacatcatgctgtgtccattcgaacgatacgaacatgaaagcaagcgcaacaaccaaacccatcaacaaccaagaacctctttgattctcaattgcagccttttttgattttttggcttccataaaaaatgtgtttaagtaattaataatagaaaatatatagcatatatactacttttcgttttctgtcttaagcattacttaaagtgctctctagctgcaataaatatagtatttttatgaataggatctcatattgttcccgagtgatatactctgttctaatcaataattccagccaatactctgtttcgttcgcttccttaagtgctatattcagcttattaataaaatcagcccgactttgtgcttgctcagcctcacgaatattggcaccaatactggtcccggatcgcaatatttgcttactcatcacaaactccttttgttcatttactaaaaacttatataaattcacaatccgaacagcgaactccaaacttttatcttttactacattatccttcatgtcctctcgcattaattgtcaattgtcaactgtcaattgtcaattattttattgtccgtagtaagcgttcggaccatgcttgcggctgaagtgtttctctaccagcagcgggttcattgttaaattgggattcacggcataagcaatgcttgccattttggcaacttgttccatcactactgcattgtgtacggcatcgtgtgcgtcttttccccaagagaaaggaccatgattcttgaccaatactcccggtgtatgtacagggttcaggccttcgaaacgttttacgatcacgtttccggtttccagttcataggcaccttttacttcagcttccgtcatatccgctgtgcaggggattgcatcatggaaatagtcagcgtgagttgtcccgatattgggaatatcacaaccggcctgcgcccatgcggtagcataagtagagtgggtatgcaccactccgccgatttcggggaatgctttgtagagtaccacgtgagtaggagtatctgaggatggcttcagccgtccttcgacgactttgccatccaggtccactactaccatatcttccgctttcatatcatcataactgactccactgggtttgatgactaccagttccgtttcacggtcgatggcagaaacatttccccatgtaaagatgactaatccatgctttaccaattcgagattggcatgaaatactttttctttcagttcttccagcatattgattataatttaaatttcgggtccttgcggtaggctttgccgttgaatttatacaaggctgcaccccgtttggaacccagtttatcgattttatccgtcttttcgataaagtccatttctgcgacacgcttgcggaaattccgtttgtccatcggttcgccgtaaatagcttcgtagagactttgcagttgggacagtgtgaacagtttcggcaacagattgaatccgataggctcgacagatgctttctgtttcatcatctcccgtgctttgtccaccatctccggatggtcgaaaatcagtgcggggagttcgttgatgtttacccagtaagcattgtgcttctgaaccagttcgcggtcgtactcattgatgttgatcagcgcatagtaggcaatcgaaactaccctttcgcctggatcgcggtcgatggcgccgaaggctcccacctgttccatgtatacgttttccaaacctgtaagttcagccagtacacgtttggcagcgtcgtccacgctttcgtctttttgcacgaatcctcccatcagtgaccattcgcccattgccggttcgaagtttctcttcagcagcagcaggcttatttcgccttcattaaaaccgaagatgatgcagtcgataccgagatagaaggtaggattcgaactataatagtttttcatcgtttgaatgaatttatttaattaccagaaataccagtagaaggcacctgtgatagcaaggatgattactgtatgaatgatatcccagtgatcccagcttgcgcgggtagccgctttttgttctttcgttgccgtaccgaataccagtccctgaatcttttcagctgtcggagcttccgtggcaaggctgactacgatgactacgatgatacagaacaggaacatccatccgcagaagaacagccagttcatatcgtagaacaaatatttgaaggtagaatctgccacttcacctgcgttgctgtaatatactttggcacccagacgagtcagaccgatgatcataccggcgatcaatccccacataccaccttgtgcggaagtacgtttccagcagatacccagcaggaaggcagcggcaatacccggagccaatacagactgaacgtcctgcaaataagtataaagtacatcacctacgctacgcatgataggaatccagagaataccgaggattacgatcactacagttgctatctgaccaatacccaccagtttcttttccggagtctccggacggaagcgtttgtagaaatcgattgtaaacaacatggcagatgagttgaacagtgaagccagcgaactcatcaaggcagcgaggataccgcatactaccagacctttcacaccggcaggaagcaatttagctaccagagtagggaaggcggcgtcagcgttggcagtaccattggcaagcattgggaggaaaccttcgccaccggcaccgatatatttctgatgtaatgcgaaagcaatcatacccggaatcaggaacaggaatacaggcaacagcttcaggtaagcgccgaagatagtaccgcgacgagcctctttttcattctttccggaaagtacacgttgtacgatgaactggtcagtacaccagtaccagaaaccgataatggcagaaccgataagtgcacccagccaagggaagttcgcatcatcgttgctgcggatcagattggtcatggtgtcaccataatcgtttaccgtcacagcaccgcacactctcatcatttcgtcccagcctcccagttctttgaaaccgagcacaaggataatcaacgagcctaacagaagaatcggagtctgaagtacagaagtataaagtaccgatttcataccaccgaagatcgtatatagtgcagtgagaacaaccagtccgatggcggcaatccagaagaagtcgattccccagagttccttgatgccgaatacttgctggaataccagtccgccggcatatactgtcactgctaccttggtcaatacataacttaccagtgagatgaccgataagatggtacgtgactgaggattgtaacggcgttccagaaattccggcatcgtgtataccatgcttcgtgaatagaaaggtacgaatacccatcccagaatcaggatcatccatccctgaatttcccagtgagccatcgccataccgcttgaagctcctgctcccgccagtccgatcaagtgttccgagccgatgtttgatgcgaagatagaggcaccgatcgcaagccatgttgcgtcacgtccgcctaagaaataatctgccgagtcattttgtttttgtctgactacccaaacaataatacctatcagagccaaaaagaagactccaattactagccaatctaatgcttccacaataaatttgatttataagttaatattatttctctgtcgagaatttaaagatacattcgctgttgtacgtttgtcccggttccagcacaacggacggccagtcggctttgttggggctgtcggggtagtgttgtgtttcgaggcagacagaagcacgttggttgtaaacgatgcctttctttccgcttacggttccgtcgaggaagttacctgtgtatacctgaatacccggttcgttggtatatacttccaatgtgattccggtttcgggagacgtcagtctggcagctacctgcgagatgtcacctttggtgttgagcacccagttgtgatcatatccgttgccgttcttgagttggacgaagtcgtagttgttgatatctttgcctaccgctttcggagtagtgaagtccatcggagtatctttgaccggagcgatttcgccggttgtcatgaaggtgctgtctaccggagtatagtaatctgcatttacatacatgatgttgtctgtcgatgtttttgatggatcaccagccagattgaagtaagagtggttggtcatgttgatgattgtctttttgtcggtagtagcgctgtacttgatgtcgatggcgttgtcatctgtcagttgataggttactttagcagtcacatttccggggaaattcgcgtcaccgtccggagagataagagtcagttccagtgttgtcggatcgataaggttggcttcgtatacttggtattgccatcctttcgggcctccgtgcaggcagtggccgaagttgttttgcggcagttggatggtatctccgtccagtacaaaacgcccttggttgatgcggttggcgtaacggccgatagaagcaccgaaatcactgggtacattaatataatcagcaatgctgtcaaaacctaaaactacatcctgcatcttgccgttcttgtcgggcaccatgatggacacgatgcgtccgccgaagttagtgatgcatacttccatacccgccttattctttaaggtataaagagctgtttgggcattgttcacttctgtttgaaattttgccgggtcaagaccggataaagtcagctcggaagccggcttgttattgcacgcggcaagcatcagcgcggcaattcctgcaattagaaaatgttttttcatggttttatttttaatgtaaatgagatgcttatcttattttgggtgtaaaagtaacacttttgtttggtgtatcaaatacactcttatatgttgtgcaacataaaaggataagaactttactgttacgtataaaactatcgcatgttcctgtcttcggagcgggatcgttatattgcattttctctttctatatagagctggatagtttctggggcttggaaccagagtttcaccagcttgaaactaaagtttcttcagtttgaaactaaagtttcctctgcttgaaactagagtttcatccgcttggaactgttggttccggcatatggaaacgaatggacctatgtacttccctaataatggttgacttgtttatctctaatagctgctatgtgttgactagaaatattactaaccctggcagctgtttactttattatttattattcctgcctccggtttacttatttcccgaatacaaaggagtaactggtgatggaatcagtttacttgaatttgttataagataaatcattttgatttagaaagatataagtgtttatgattgcatcattggcgaaatgactgatttgtgctattatttggaaagaatgttgcctccaaactatcagaatttcgccaattttgcaatctaaataaaagatgttcgttgaactaatttataataatacttatatcaaccatgaagaatttagcattatgggctgtttctgccctttttgtagctgcttgtaccccgaaagccgagcaaccaaccgactccggcctgttaagaactaacttccagactgaagtaggtggtaagaaaaccgatctgtacacccttcgtaacaagaacaacatggaagtttgtgtgacgaatttcggtggacgcattgtttctgtgatggtccccgataaagacggtaagatgcaggatgtagttttaggtttcgattctattcaggattatatcagcaaaccttctgattttggtgccagcatcggtcgttacgcaaaccgtatcaatcaaggtcgattcacattggacagcattgaatatcagttgcctcagaataattacggtcattgcctgcatggcggtcccaatggattccagtatcgtgtgtttgacgctgtgcaaccgaatccgcaagaagtggaactgacttatgtcgctgcggatggcgaagaaggtttcccgggtaacattacctgtaaagtcctgatgaaactgacagacgataatgcaattgatatccgctatgaagcagaaacggataagccgactatcgtaaatatgaccaaccattcttattttaaccttgacggcgatgcagcaagcaatgcagaccacttgttgatggtggatgccgattattatactccggtagacagcacattcatgacaaccggcgagattgttccggtagaaggtactccgatggatttccgcactccgactccggtaggggcacgcattaacgattacgattttgtacaattgaagaatggaaatggttatgaccataactgggtattgaatgccaaaggggatatttcccgcaaatgtgcttcactcgaatctcccaaaacgggtatcgtactggatgtatataccaacgaaccgggtgttcaggtatatgccggcaactttctggatggttctctgacaggaaagaaaggtatcacatataatcagcgtgcttccgtatgtcttgaaactcagaagtatccggatactccgaacaaaccggaatggccttcggctgtgcttcgcccgggagaaaaatacatgagtcagtgtatctttaaattttctgtagataaggaataatctgctcgctcccaagaaataaaaaaaatattttagtctcacggtctcactgtctttctgtaaagatcagataactagatgaataatgaatgagagataccttcggagcagggtgtctctcatcgttttatcccataatatgctcccaaacagtgtatctctcatccttttttaagttgtctctcatcattctttctgctacagactacagctgtattgattttactttacctatcatttgtatgttgtgacacttatgtccttagcatatctcccttacattcttatattatcttaccgacatcttcatcgttccacccgggtgaattgatcattgcacccaggtaaaccgatcgtgtcacaaacgtagacagttcgttctacccgggtggaacgatgaagatgtccttacgaaaaactgataacaataagtgaaaattaagcgattatagggttgcttggacgaagagaaacggtaaatcagacaataactgccgcagtttataattatgtccgttatttgtttgcctttaaagttttggcaatctcttcgaccataaaaggcgtattcttatttatgttttcgccttccaaatgcactgttgtgtatgcttttagtacaaacatgtttttctcgataaatgatgtttcatctcagccttaattttttgaatgattgtagaattcttttttataggtttttctatgattaattgagccagcctatttgccttttctgcctttccctgtttcatgtagacataatgtaacctataaagaggtataaaccttacaggacacattaaggtagctttctctaaatgatgtttggctgcatcatattgttttaggccaatatatgcctctgcttgtactaattctaaattgtaatctgaccaataattacagcaaatagccgttattgctaagcattctttatatttttcggcaacacaaagttcggcagagtaattatataagaaataaggatttcttctaaaagtatgtagtaaattatggtatcgtggtaacatgtcattggttcgtccacagagcgacatatgcgctacttttccccattccagttctgctttaattctgctcaccacttcaataagcaaaaataaacttcctattaataagaaaaaagcaattcctctttttataattgttgttttttgaaacaaggtattttcataggcttttcctattaaagtactaacacttaatgcactaataatccaaatgaagggataagtgaatggataagagaaaaaagaaaaaactgcaatggaaagtaaagagagcagagacacatatcctgctttggttgggtgcttcctgtgacaaagaatcaagaaaataccagcagctatcaaaagtacccaagttagaataccaaactggactccgacagaaaggtattcattaaaaggactcttaatattgtctgctaaaattgcaaattgactatccggatgttccttgaaatattgggcttgataatccatatagtgtgcgctgaatcctccgactccatatcctgtaaaaggctcatgttttatcatttcccatgtgcaacgccatattaataatctaccatcagccgaatctttttttagatgatagactgttacagaaatgacaaatatactaatcagcagaaaggatagacagagtaagaagctaccgatatgttttttatagtggaacttattcttgttttggtgaataaagtaaattactaatacggtaaatatactaattgacccggcgcgagattctgatagcaatactcctaagacaataacaaacaatgcacaccaactggcccattgaacctttttgtttgaatattgtaaaaaatagaaggtaaatggtaaccctgcgcataaacttcctgcaaaaccggcaggattatcaaagctaccgacaacattgtaggtgatggaatgtgaagacagtatattgaaaaattgtaatataccgtatccggcttgaagaaaacaagatataataaccgtgtagtaacaacattttgcattgcaaataaacctttttcctcggaaaagataaaatgaaaaaaaacatccaattactcctaatcctgtgaacataaacatccatttagggaaaatttgggaatctgtaaatgtgtttgcatttacgaataagactcccaaactcaacagaaaatatagaatagaagaaactggaatgcttttcatttatttatattagttgctgtttcaaggctctaagacgaaatatttggtgaaatcttcactgtgagtcgcacctttttcgtctttgaagaaaagatttccgtagcaggttccttgcagctttccttcgacttcgttatattttacaattggcaggtcgttgcatgtaatctctattccagagtaactaatacactctaattcattttttatcggatatacttttttattcattttgtcatatccataaatcacagttagtttataatgcgcgtcatagccgtccctgctggaataaataataccgctttttttcctgcattctaagatttcggtgttccaatttgtcaaggagtcaattttaaattcatcagctacacaaaataaagagcctttttcgatattgtatgaaccattttggattcttgacacagtattttgcaagaggtgaagtatttctttttttctttcttgagagatatcttttttgagaaaagagtagtcaatttgaaaaacagaactcatgacttcccataatttatattcctcatgattaactttttctttgacccactgtggtacttcgtccaatttggagtattcctgagcattgcatttaaatggcagattacaaatccctgcaaaaaataggacgaataataatttatagatggacgtatgattggtatttagaatgttgttcatggtgactattatttttaattgttctataacttttttcaagatctgaatagaaaatcacaaaagagtactaactgtaccaagattaatcttgtgtatattcaaattgatcatgggatcatgaatcctgtcttttgtacagttacctcaacctttctggatccatctttgaatgataaagttccgctacacgatgcggctattaatttcttatccttatcgtaagaaacactggaagcaccagaaaaactcgggtcatttcctaaatatggtgatcccgtataaacactcgatgacgtaattgtaacatcatcatcggattttttgtaagtaacagcagcttttatatagggacctaagctatgtgtatacaatgtacatccatttgtcttatattcagctcctccttctggtgatcttgttgctattctgccaaaatattgtgagtctgatagggtggtgccatcttcatctgctatatttaggaatccttcatatttattaatctgccctttttctattctttcacagatgttgttgatgcaatcatagatttcttttttccttttttctgaaatatccttttttaaaaaggaataatttatttcataccttgaactcatggttctccatagttcgtattctttaggtgtcactttttcactaacccaatcaggaatagtattgagaggagcgtactctggattttcttcaaatgattgcatcggttcatttacaacccagtcttcattttgttcgcatgccattagtgatataaaaatacataatgacattaaatgtcttaatcgattcataagtgatatttatttaaaattaaatggatgtcatgttcttttttaggacttcatactctttttgcaaagattctgattcatattataagttgagttactttataagtaataaacaggagtatatttgctccccctttcatatagaataccactcactaaaaataatccctagtgagaaatacaactttttttgctgttattaaaaaaagaggagaaaaagatattttcaagatcatcaaataaaaaatatcaggaaaggagcatactctttcagattatcacgcagcagcttcacagctttgcttatatgatactccactcctttgacactgatacccaattcttcagctatttctttatgagattttccatccagacgatcggatataaatgcaatgcgcgtcttttccggcataccagccaacaatgttttcacctttgagcgtaattcttcggacataacttccttcggatcacaggcttccaaggttgaaatacggatttccaattcccgttgtcccttatctgtcaggttttggtagacgttttcctgaacctgcaaatgtttcaggtaattgagtgacttgctacgtatataagtgattaatacagcttcgatactcggaatttcctgttttttacttaattcccacaaataaatgattgcttccgatacaatatcttcagctaccaaatcattatggacgtatgataaggtaaacaggaatgctctcctataataggtagtatatatcgaattaaaattaattgcagtcatttcgatctatattaatggcgcttatgcgtatagtttaagtatatccaaaggtctttaatgattgcaaagaaatatattttaattgaataaaagaactttttgaagagaaaatgggacataagccggtaaatcatcagaaggctgacgactagcatatagctttcactcctttctctccacttttttccaatgctaaaaactgaccaatttatgctaaaatcagatcattgcatcatttctatactattatgactcaaaattgctctaatctataaatccaacttcctatatttgcagccataacaattaaaacacaaaaagaatatgattacaagtagaaaggtttctcaggtcaatgtttttgctggtagtccctgggaagtagccagcgtaaagagtttattgaaagcagcgtatatcgaggcatcaatgaaagacaatggattgaacagtatactcatttctgttccatgcgaatattatacagcagcaatgcgtgtgattaataaaagaaaagtttcataggttttaggttaaacatataagattaaagccgggtacgatgggagatcgcactcggcttttcagtctttgtatgattcttttaaaacgaagtaacctttagattggttgactttctgtttgtttaatcttcagtttgctcaatttctactttttcattctttagcttttcaagagcggcaatctgcatattacagaaaaggtgtatgtgatgaatcaagttagtatgctgtgacaagtaaacgacagagtccataagttgggcagacagttggtaggctttccgattatttgtattttcgtccggacgacgcatataaagggcaaaacttcggtacaagataggaataaagcgttcccacggaagttctaagctaagcaacaaatggttcatattctccagcatacgttgaagagactcaaggtccggcttatcagattgcttgccatacacctctgcccatagacgggcttcttcttcaaaaaaaatttcattgggactttctttcgcgttagtcaaagcgttttcagtatccataagataaaagtttaataaaggggcaaaaaagaacggtttcgcctttcccgttgactaacacatcttaggacgctggaggtacattacatactccccacgggggtacgaaaccgcctatgaggaaagctacaagcaaaaaatgcctgcaacttatcaaaagcaggattccctgcgtcccattataaaatgttagtcactgcaaagatactatttttcaaatataagtatggaatatctgtagatttattaatcagaatttccacaatagcctccatagtaatttgacagcagttttgctctcatgccctaacaaactgtctgtatccctttattcatcgtagttttcggtgtggtagcaactgtggtggcaggtatgagagcaaacggttgctctcactctgtttcgtcctgactagtatcgtttctacattgctatcttttgatttacaggatgttaatatctgacatctcagctattaatgactgataccccatacattattagccaataaatgattcaatgcttctcctaaaagaactggtcaattgaaataactaacatggtcgagtcaatccaaacatacggtcaaagtgaatccaatcgacagatgtttcagaaagtttcaaacgcttgaactaatgattccaagctgttggaactaaagtttcaagcctttggaactatggtttcaagcctttggaactatggtttctcttcgctgaaactatagtttcaagacgaggaaactaatttagttgtcttatcctaaattgacattggaattacaggaataaaatgaagatactacaaaggttagagattggatttagaaaagtgagggcaagcatttgctctcatacctgctaccacagttgctaccacaccgaaaaccacgatgaataaagggatacagacagtttgttagagcatgagagcaaaagtgatgctaaattactattgagcaatccttgataattctctgcacaacaaaagtgcagaaatatgcataatactgcacttttgttgtgcaattatcacatcattgcagataaatgcacttcagctatggattgcttatacgaaaacttcaacaagttatttaaagagtacgagcacgaatatagcacccattcgatctatcccactttggtattttggaatgaattattagtaaactaagcaaaagcctttttcttcttttagtccacactatttttataaaaggcactaattttattgaattacctcactaacagagcgctagatttcaaaaagaaacttaactttgcacccgagttttatataaagagactgaattagtaactaaaaagattaaaccgcatgaaaattaagactttaatagcctgtttcatactagcttgtgctgcaacttcctgcatacaggatgaagcactgaactcagaagcagccattgatgcttgtacaggtgatgatgtacaattagcaaacatcaatgctgattcaaagctgatcaatgtatatgtaaacaagggagctgacttgtccaaacaaaagttagaatttgtaattccggaaggagccactataaaaataaatgatcaagttgctggagatacagaagccacatatgactttagtgaagagacacattcccggaaattcactgtcacatcagaagacggtcaatggaaacctgtttataccgtcaaggttgttttagcagaattacctacttctttcaactttgaagagttattaccttccaatgactacgatatcttttatgaattccagccgggcacttcacaagaaatatctaaagtattacaatggtcaagtggtaatccgggttttaaattgacaggtatggcaaactccaaaacagattacccaactgtacaggtagccaatggtttcagaggtaaaggagttaaattggaaactcgtgataccggtagttttggagcaatggtaaagatgtatattgctgccggtaacttatttatcggaacatttgaggtaggaaatgcattaacagatcctagaaaagccactaatttcggtttccagttctataaacgccctaaaacgctcaaaggacattataaatttaaagcaggagatgtatattccgtagaaggaaaaccacaagagggtgtaagagacaaatgtgatatttatgctgttatgtatgaagctgagaacaattctgtcatgcttaatggtgatgatgtatttacttcagataagttagtatcattagcgcgaattaaaccggaagatgttgttgaatcagatcaatggactgattttgaaattcctttcgaaccggtaaaaggacgagtaattgatgataccaaattaaagaatggaaaatacaaattaggtatagtgctttcgtccagtgtagacggtgcttattttaagggagcagtaggcagtacactgtatgtcgatgaagtagaacttatttgcgaagactaaaaaaacaagaaaatgaaaagatataaattactcaatattatagctgtactactattagtaagtacactttcagcgcaggcgcaagaagaaagaaatcaaggtatcatctggtcgtacttacacggatgggaatatggaatcaaggcaggtttcagtattggaggaacttctccattgcctctacctgaagaaattcgcaaaatagatagctatgcccctggtggcctcgccatttcaattgaaggaaacgcaactaaatggtttgacacgaaatggggaatgactgtaggggtacgacttgaaaacaagaatatgaccacagaagctacagtaaagaactatgggatgaagattatcaacaccaacggtggagagttacaaggcttatggaccggtggtgtaaagactaaagtcaaaaactcttatctgactatcccagtagttgccaactataaagtaagcaaacgttggaaagtctcagcaggtccgtatgtatcttatcttattgaaagaaacttctccggacatgtatatgaaggtcacttgcgtactccggatcagacaggttcgcgagtagattttactggtgaaagcattgctacttatgatttctctgacaatctgcgtaaattccaatggggattgcaactaggcggtgagtggagagcattcaaacatttaaatgtgtatgctgatttaacatggggcttgaacgatatcttcaaaaaggattttgataccatctcattcgctatgtatcctatttatttgaatataggattcggatatgcgttctagagaaaacactacaatttatttaaataaaaacaactaaaaaagccgttaattttaattgcattaatgtatacaattggaattaacggctttttctgttatatatttcttatactcaacacactattgaggtgttaccgtaaaactatcaataaataaggtactaccaggaggtaagcccccgataaagtacccgttgtctttgtatctttaagtctcgatctttgccagaaaaaagactatgcaaaaaatgagtaaagaagaattcattgaaatcctgtctcgtcaacagcgtagcggtttgacgataaaagacttctgtataaatgaagcctataccgaatcaagcttttactattggaaaggaaagtttggcctatcgaggcgttatcatatggataggcattcttcctctttagaggagtttgcaccggttagcctcacctcttcacctgcttcccactctgcctgtgatagtggcgctatacaaacgggtgagatccggatagagttccccggtggtattatcgcccacttcagtggtatggctgaatcccaggcggccatgcaattgctcactcaactctgcaatcgccatgttttgcctgaatgacacgatgcgctactttctctgtccgggtaagacagatatgcgtaaaggtatgaactcattatgcggggttgttcatgataaaatgggatatgatgtccgtttaggtgatgtgtttatctttatcaaccgccagcgcactacaatgaaactgctacacgcggaagatggcggactggttttgtacataaaacgacttgaagaaggcactttccgccttccctcttatgacaaagaaagcaagtcgtaccctatgcagtggcgtgacctggttctgatggtagagggaatcaacgacgaaccttccaaaaggctcaaacgtctgaaagcgttacgaaaaagtgacatgcagtactgaaaaacagcaggtgaaaccttgattatacggttgcttttctgtatttttgtattgttcaaaacaggtatgacgaatgactcagacagaaacattagaacttttggtggccacactccagcaggctaatagctcccagtctgagtcaatcgagcgtctgacccggcagaacgaacagctgcaaaataagcttcaggaactgctggctcaggtagcctggttaaatcgtcagttattcggccgtaagagcgagaaattagcccatctggatccgaaccagctatcactgttcgatccacctgttcagccgttggaacacgaaataccggaagaagccgcagcccaagaacctgtctgctcgacgactcccaaaaagaaagtgcgtcagaaccgcaacatgttggatggccttcctgtagtggagattgtcatagaacccgaaggagtcgatccggataaatacaagcgcataggcgaggaacgcacacgtacacttgaatttgaaccgggcaaattatacgtaaaagagatcatacgtcccaagtatggcctgaaagacaatataagtttgcctcaggggcatcagggcagtgttattatagcccctcttccgctattgcctatctacaagggacttcccggtgccagcctgctcactgaaatcctcttgcaaaaatatgaatatcatgtaccattctatcgtcaggtgcgtgagtttcaccatttaggcctgaagatctcggaaaacacgcttcaggggtggttcaaacctgcctgtgaattacttaaacctctctatgaagagttgaagaaacaggtattgaaggccgactatatccaggtggacgaaacgacattaccggttatcaacaaacagaatcataaagcggttaaggaatacttgtggatagtcagggcggttatggatggattggtcttctttcattatgatgacggttcccgctcacaggaaacagcctggaaattattacaaaccttcaaaggatatcttcaaagtgacggctatgcggcctacaacatctttgagggtaagaaagaggtgtgccttgtcggatgccttgcccacataaggcgacattacgaggttgccaaagaagagaatgaatccctggccggatatgttctggctcaaatacagcaactctatcggatcgaacagattgccgaccaggaggaactcacttatgagcaacgcatgcttagaagacaggaacaggcacttcccatacttgagcaactggaaaaatggatggaaacagcctatccgaaagtgcttcctaaaagccggatggggcaagctatcgcttacgcgtatcaactttggccacgtatgaggaattatctgaaagacggcaggcttaaaatagataataatctggccgaaaatgcgattcgtccgatagccttatcaagaaaaaacttcttattttgtggaaaccatgaagccgcgcagaacactgccataatctgttcgctcttggcatcatgcaaagcctccaacattaacccccgggaatggctcacggaggtgattgcactattgccgtattatgcagccaacaaggagaaagacctaaaagagctgctaccccattgctgggaatcgggaaactccaaagaactctaataatactctaacgaaaaacaagaatataaatacagaatcactatagctttgttcgatttgctatagcgattcttttttatacgggtactttatcgggggcttacattgcttgtagtattttcatagttctattgtttttatgtgtaactatatttgttaaaacgttgcatgccaatcgcaccaaaaggtccatgccggttcgttcagtctcattttgtcttctctatgctttttaagcatttcctttgcttgagggtaatcataccatttgccggctagttcttctccaaatggtcctgaagaaccggggaagaaatcggtaaatttcactcgttgatcagtatcggagagaactatcagttcttcggcatacttacaattggtttctatttgttcgaaccaattatgttcagaattattcttataaaaacaattatagtcgagtacggtaagtgttctttgatcaactaacttgaattttctatatcctagctgatataaagcattcaaagtgtccaattcgtgtcctgctatatcttcatcttctcctatgcattcagtttctactgatatatatagaggtttctcactcactttttccatcgtttgcagtgcaatgatgtcatttccttctatatctattttacaataaaaaggagtaccgtattcatgaaacaaatggtccagccgttttgatttaatcttctttttaatagccttgcagcacattcttgaagaaatagaaactttagttgaactccaaatggtatttggaccgatataaaaatcggtgtctacgtcatttgtgtcagaaatcacatagtttagcaacaatagctttccattctctatgtatttcttaaaaatattctgccattcatttattaaatcagggtcagcatccacagcaattacccgataccctttcaaaagataaaaaagggtatcttctcctttatgaaaacctatatcaaaaatgagattttccattagactattttattttgtataaataataagtttatcattgtcatcaatctttcttttatttcagacttattgatttcatgtgtttattcgctcttgcaaaatgctctcttattttaccctgctgttccatattactctgagtaacatccgagtacccaaaatccttttgttctgagataaaaggatagataaccattatgtttgtggctagtttggatattactccatcggctgtgtcagtattctgaaacgaataatccagcatcttatcaaaaaaacgattataaataacaatgaactgtgtgcaccaaaaccagtcaactttataacgatgatatcctgcagggatcgcttgtccaaatcctccaataccaccggaaagtacttccgctccttgtatataagcttctgtaacttctttgaacagtaatttgggagaataattttccgtgaaataatggtcgtcttcgcaaatgacaatgatgtcatctcctttctcttttgccatttttatgattttgatcatactattccataaacctactgcaccgataggatgggccgaagcctctacccaatttaactcgaattcttccttgttgtcgaactccttagtaatatgttgtttacgttccactctttctctcatattgataacataaaccggaagataaaaatccggttgatgctcggatgcaagctgttctataatcttattgcttttatcgagccatatatcccagtttaaacgttcttcaaaatcctttcgtgcagttttccttagtttggaatatgttatatggttattgaatatctcttctattttatcagcatattccagcgaagaagcatcgatgttgaacagaaatccattttctcgttctttgataacctgtgatacacctcctacattagtgcctaacgatggaataccataggcgcatgcttcgcagaaaactattccaaaacaatcaaagcgagtgggcagaatcagaaaatgcgatcgtgtcaggatctcatggaattttaacctgtcattggagtttgttttgtcgataaaagggtatatttcaatattcggatcatttggtaaggacattggaggttcacttcctacaatagtaagcgtacattgaaatccccttccttttagattatgataaatttcaagtactttatttccacctttcatattccaatttcttccgataaataagaggttacatggtgcatttatcggcgatacgttatctggaatcgggatgttctctgtgatattcgctccaaattcaaccacttctatgttctcggcatcagcattgtaatcctgcattgcgctctgttttgcccattccgaacaataaataattttatccaccttttgtatagcgagtgattccagttgttcggctagtttggtaagacttttgtcctgccagttcatgtattgattaaacagatgaaatgtagtatctccaatataaataagtggtatatccgaaacgagatatgcggcaaagaaataatctcggcatataattacatcataacattcctttttcaataggtcagaaaacaatttaccaaaaagcaacgcataattttcaggaaagaatgtttcattgtttttgaaattggctttgtggaattcccaaacctcagcaaacacagtttcgcctacccatatcaccctatgtttcttttgaagtgaagtgtatagagagtaaagagtacctgaccagttattttgatcattagggtttgatgaagataaaaaagcgatattcatggttgttctaattcaatcagatgtataatttatgactataaatattagatacttattaggaatagccctccttttttctttctctgtgatcagtgcacaagtacgaacctcgtatacttttgagaaagggtggaagtttacacgtgaagataatgctgattttattcagcctgactataatgatatcaagtggcaatctgtggtagtaccccatgactgggctatttatggaccttttggtatagataatgacaggcaattgacagccattgcgcaagacggacaaaaagaagcgatggaacatgccggacgtacaggtggtcttcctttcgtcggagtgggttggtatcggctgaattttgatgctccctcttttgtcaaagggaaaaaggctacattaatttttgacggagctatgagccatgctcgtgtgtatattaacggtcaggaggctggttattggccttatggatacaataccttttatctggatgtaactccctatctgaaagaggggacaaagaatactttagctgttcgtttggagaatgagacagaatcttcccgttggtatccgggagccggactttacagaaatgtacatctggtagtaacggaagatgctcatattccgacatggggtacacagttaactactccggtagtgaaggatgattatgcgaaagtgaatataaaaacgactttggtcgtaccttccggaaaacagtttgatgcataccgtatagtgactgaacttaaagataaggatggaaaagtagtaactactgatgaaaaacaaggttcccgttttgatgataatatcttcagccaggaacttgttgtcagtcgtccggctttatggagcccggaaactcctgttctttatcaggctgtctctaaagtctatgaaggcaatatactgaaggatgaatatacaacatctttcggtattcgtactattgaggtcattcccaataagggctttttcttaaatggaaagagaacttcattcaaaggcgtatgcaatcatcatgatctcggccccttgggaggcgctgtgaatgatgctgctattcgtcgtcagattcgtattttgaaagatatgggttgtaatgcgattcgtacttctcataatatgcctgctcctgagttaatcagagcttgtgatgagatgggaatgatggtgatggcggaatcgtttgatgaatggaaggctatgaaggttaagaacggctatcgtcatgtttttgacgaatgggcagtaaaggatttgacgaacttgctacgtcattatcgtaataatccgagtgtggtgatgtggtgcatcggaaatgaggttcccgaacaatgggatggaaataaaggacctaaaatgtcttattttctacaggaactttgtcatcgtgaagatccgacacgtcctgtcacacaggggatggatgcgccggatgctgtagtcaataataatatggcggcagtaatggatattgcgggatttaattataggccacataaatatcaggagaattataaaaaacttcctcaacagatagtcttgggtagtgagactgcttctacggttagttcgcgtggagtatataaattccctgttacccggcaatggatgaagaaatatgatgatcaccagtcttcttcttatgatgtggagtcttgttcatggtccaatctgcctgaggatgattttattcagcatgaggacttaccttattgcataggagagtttgtttggacaggattcgattatctgggtgaaccgactccctattatacagattggcccagtcattcttcactatttggaattatcgatttagcagggctgcccaaagaccgttattatctctatcgtagtcactggaataaagaacaggaaacacttcacattcttcctcactggaattgggaaggacgagagggagagataactcctgtctttgtatataccaactatccttcagccgaattattcatcaacggaaagagccaagggaaacgtaccaaagacctttccgtaaccattgataacagtgctgactctgtttccatcatgaacctgaagcgtcagagccgttaccgcctgatgtggatggatacaaaatatgagccgggtacggtgaaagtcgtggcttatgatgctgacgggaaagctgtagctgaaaaagaactccatacagccggtaaaccggatcatattgaattggtagccgatcgtaatgtaatcaaagcggatggaaaagatttatcttttgtgacagtgcgagtggtagatagagacggtaatctgtgtccggatgcctcacatgaaatcagtttcaaagtgaagggagagggtagttaccgtgcaggagctaatggtaatgcagcttccttggaatctttccagcatccgaagatgaaagtcttcagcggtatgatgactgctattgtatcttcgacagagcaaccgggcaaaataacccttgaagctacgggcaaaggcttgaaaaaaggagccttgatcattgaaagctgtcaggaagctaagaagtaagaaatatcgttgtaatatgtgtaattcctctaagtgtttcattgcgatacacttagaggagtttttgtttaagcaggcaggagtttaacatctttgcaggcaaaataaaagctgtaaaagtatgttcttttattaaattgtattacttttgcatcgttttagtactgtatccgtttctctatgaaccttggttcttatatggagataagataaaaaggctaaatccttaagagatgcgctactgcttcataaatggatttcatttatgaaagtcagggcgcttttgtcttttaagtaagtgatgaaataaaaaacaaggggtaatgggtgataatgaatgatttggacaaagaacgacaaacagagggaaggaaggcatggtatgctgtacaaaccttctattgtaaagaagaacatttggggaaatatttggaaaaaaaaggggtaaattattttattccgatgcgatatatcgagcatgagacgcttgatggtaaaaagcatcggaaactgactccagctgtacacaatctgctgtttatcgagaaagaatttacggaaaaagaacttttagaaagggtaaaagattgtactataccttttttgcttgttcgtgaccggagtacacggcggtgttatgagattccagactgtgagatgttggaattccgtgccgtatgcgatcctaattataaaggaactctttatgtcgatacagtaacagcagaagcccgtcccggacaagcagttcgggtgatccgtggcccgtttgccggacttgaaggcaaactcacgcaatacaagaagagctattacgtagttgttacgttagctactatcggcgtcatgctacatattcccaagtggtattgcgaaaaaatcaactaatcataacattacgatcatctgctcaacaccttgttgtcggacacttcatgtttgacctttagaactgtttttttaatctcggaaggtaatctatttatttaataaaatattcatttttttgagtggaaggatatataccctgccactcaaatcttgagtactaataacaaatcaatgaaaggaattgttttagccggtggttcaggtactcgtttgtatccgatcacaaaaggagtgagcaaacaactgctccctatctttgataagccaatgatttattatcctatttcggtattgatgttggctggtatacgtgagattctgataatttctactccttatgatcttccgggctttaaacgtcttttaggagatggctcagattatggtgtacattttgaatatgcagagcaaccttctccggatggattagcccaagcatttattatcggagaagaatttatcggtaacgattccgtttgtctggtactaggtgataatattttctatggtcagggtttcacccatatgctgaaagaagctgtgcatactgcagaagaagagaataaagctactgttttcggatactgggttgccgatcctgaacgttatggtgttgctgaatttgataaaatagggaatgttctgagtatagaagaaaaacctattcagccaaaatctaattatgcagtagtcggtctttatttctatcctaataaagtggtggaagtagctaaaaatatcacaccatcttcgcgtggtgaattagagattacggcggtgaatcagcaatttctgaatgatcaggaacttaaagtgcagctgctaggtcgtggattcgcttggctggatacaggaactcatgattctttatccgaagccagtacttttattgaagttattgagaaacgtcaagggttgaaggtagcatgcttggaaggtattgccttacgtcatggatggattactactgataaaatgcgcgaactggcccagcctatgctaaagaatcagtatggacaatatttgttaaaggtaattgatgagttaacacagaaataaacttaatacttaattttcaaaataatcacagtggaagttattaaaacagctatagaaggtgtgttcattattgaacctcgtttgtttaaggatgatcgtggctatttcttcgaatctttctcgcaacggaaatttaacgagaaagttcgtaaagtgaattttgtacaagataatgagagtaagtctagttatggggtgctacgaggtttacattttcagaagcctccttatgcacaaagtaaattagttcgtgttattaaaggtgctgttttggatgttgcggtagatattcgcaaaggctcaccaacgtttggaaagtatgtatctgtagaactgacagaagataatcatcgtcaattttttattcctcgtggttttgctcatggattcagtgtgctgacggatgaagttatttttcaatataaatgtgataatttctatgctccgcaaagtgaaggggctttggcatgggatgatcctgatttgggtattgattggagagttccggcaaatgagattgttttgtctgagaaggataatcatcatgaattattgaaagatgcttcttggttgtttaactataatgaaagtctatattaaataatgaatattctagtaactggagctaatgggcagcttggtaatgaaatgcgatgcatagcagctacaagtttgaataattatatatttactgatgttgcagagttggatattacagatttagatgctattcgtaatatgatacatgtgtggaactaatattaatcctgaattaatgaggatagccgttgttatcgaaacattgaaaagacagggtgttgttgttacccgtcataatttgcgggacgaaccgcaagtttatgtaagtaacaagactgtaaaccaatatcttcaaaagaatggtgcagaagcactgcctattactttggtggatggtgaaattgcagtttctaaagattatcccacaactaaacaaatgagtgaatggacaggaattaatttagacttgatgcccgttaaataatcgttgaacaaattaatatacagaataatgaaagcatttaatttatccgatatagaactaacaaaatacttattcttcacaggaaaaggtggagtaggaaaaacctctattgcttgcgctacggcagtgggattagctgataaaggggagaaaattcttcttatcagtacagacccggcttctaacctgcaagatgttttcaatcaaaccctaaacggacatggtacagctatttcagaagtaccggggctgacggtcgtaaaccttgaccctgaacaggcagcagcagagtacagggaaagtgtgattgcaccttttagaggacaattacctgaaagcgttattcaaaatatggaagaacaactttcaggctcttgtacggtagaaatcgctgcctttaatgagttttcagactttatcaccgatgctgataaagcgaaggaatacgaccacattatttttgatacagcacctaccggacacacattgcgaatgttgcagcttccatcggcatggagtacatttattagtgaaagtacacatggcgcatcttgtttaggacaattatcaggcttggaagaaaggaaaggtatctataaacaggcggttgatacattgtctgatacaagcgcaacccggttagtattggtaagccgtcctgaaatagcaccgttgaaagaagctgcccgttcttcgcatgaattacaactattgggaattaaaaatcagctattggtgataaatggtgttttacagcaattagatgaagcagacaatgtttcacaacaactgtataacaggcagcaaaaggcgttacaaagtatgcctattgcattatctgaatatcccatgtatagcgttcctctgcgttcttacaatttatccaatattgccaatatccgccgtatgctatacagtgatagtattacgaatgaaattcgttatcagccgataactgatagcaaaagtatagatgaattggtaaatgacctctatacttccggtaaacgagtagtgttcacaatgggaaaaggtggcgtaggaaaaacgaccttagccacagaaatagccttgaaattaacaaagctcggtgcaaaggttcatcttaccactactgacccggcaaatcacctgaactatgattttgccatcaaatcaggtattacggtaagccatatagacgaagcggaagtgctggaaaaatacaagaatgaagttcgtagcaaagctgccgaaaccatgactgccgaagatatggaatatatagaggaagatttacgttcaccatgtacgcaagaaatcgccgtatttaaggcttttgctgaaattgtagataaagcggagaatgaaatcgtagtgattgatactgcaccaacaggacatactttgttgcttttggatgctacccaaagctatcacaaagaagtagaacgtacacagggagaagtaaccggagcagtagccaatttattaccccgtttacgcaatccacaggaaacggaagtagtaatagtcactttacccgaagcaacacctgtttttgaagcagaacgcctacaaatggatttgcagcgtgccgggattaacaacaaatggtgggtagtaaatgcctgtttgtcattgacaaatacagcaaattcatttttgcaagcaaaagcgcaaagtgaattgacttggattaagaaagtagaagaattgtcaaagggcaatactgccctgattgaatggaaaaacttataagaatatgaagattttaatcctttgcactggtaacagttgccgtagccaaatggcacacggtttcttacagtcattcgataaaaacatggatgtcttttcagcaggaacaaaacctgctgaaaaggttaatccgatggcggtaaaagttatgtctgaaacaggaatagaccttaccaaccatacccctaaaaacgttagcctgtatttagggcacgaatgggactatgtgataacggtatgtggcggcgcaaatgaaagctgccctatgtttacaggcaaggtaaaaaacagattgcacattggatttgacgacccatcagaagcgaccgggacaccggagtttataaatagtgaatttcttcgggtacgggatgaaataagaatgcgtttctatgatttttacctgcaagaattaaaaccgcaattaaaataaagggcagtcattatggaaaagaaacaaggaattggattttttgaaagatacctgactatttgggtagccttgtgtatcgttatcgggatagccatcggacaatatcttccggcaataccgcaaacattgagcaaatttgaatatgccaacgtgtctatacctgtggctatcctgatttggttaatgatatatcccatgatgctgaaagtagattttcagagcatcaagaacgtaggcaaacgtccgaaagggattgtcattacttgtgtgacgaactgggtaataaagccattcaccatgtttggaatagcttatctattcttctacgttattttcaagtcattaatccctgccggattagccgaagaatatttagctggggcagttctgttaggtgctgcaccctgtacggcgatggtgtttgtatggagtcatttaaccaaaggggatgcagcttacacattggtgcaagtggcagtcaatgatttaataatattggttgctttcgctcctatcgttgcgtttttgttgggtgtcggtggcgtttctatcccgtgggacacgcttatactctcggtcgtactgtttgttgtcattccactttctgccggaatagtaacccgtgtaacggttatccggcgaaaaggaatagactatttcaataccgtctttgtccgcaagttcgataactatacggttggcggattgctattaacgcttatcatcctgttttcgtttcagggggaaacgatactgaacaatccgttacatattgtcttgattgccgtcccgcttgtcctgcaaacggttctgatattctttgttgcctacggttgggcaaagtggtggaagttaccccacaatgtcgccgcacctgccggaatgattggtgcgagtaacttctttgagttggcggtggcggtggctatttctcttttcggcttacagtccggtgctgcactggctaccgtagtaggcgtattggttgaagttccagtaatgcttatgttagtaaaaatagccaataatacaagaagttggtttcctaaagtaaaataagaatgggcaagtcaggaacaatttggtcgatgatagcaagtgtaatatcaccattacttgctttattaggtgtaataagttgctgtgggctacctatattagccggaatattagcaacattaggaattggagcgtcacaacttagtttttttgcagagtataaaggttggtttattggctttgccatcatctccctactctttggcttttatcaagtttatttcaaaaaagaaacttgtggatgtggaacgaatgtttcagaaacaaatctgaaaagacgttccaaatcaaagtctttccaaaaattcttcttgtggttaggtgtggcaatacttgtattcgttctgtttattggaaataaaaatcaaacagtccaaagcaatgaaagtggcggatgctgcccggcaaacacacaatcagtgcaaccagaagaaaagaaatgttgcggaacacagccacaacctgaacaggaagaaagctgttgtgacactacatttaattaataaatagtttttaattcaatagattatgaatactttattagacacattacaatacttcgtatttattacgattgagttgatagccttatttctgttaatcagcgcagccgtagaaattatactgatgtatatcccggaagaaacgattcggaaaaagctatcaggttcgggtattatgggcaatgtcatagctgccggatttggggcattaacccctttctgcgcttgctctaccattcctatgacagtaggttttctaaatgcaggagttccatttggttctacaatgtcctttctgatagcttctccattactcaatcctatcattataggtatgttgggagctttggtaggatttaaggcaatggttttctattttgtcatcgcttttatctgttccgttgcatttggatatgttctcgaaaaaataggcgcacaaaagtatgtgaaaaatgttcgggtgaaacccagttgttgttcaggcagcgaacagcctaaaaacaaaaggttgcttcctttccgccaaaaaataaagattgcttttataaatgcgtgggggagccttagacctattatgatatatttactgataggtgttgctctcggtgctggcatttatggctatatgccgcaagattttgtgttgaaaatagcaggtgcagacaatcctctcgctatacctgtggctgccgtattgggtattcctctgtatatccgtgcagaaacagctatccccatcggcatagcattgatgggcaaaggtatgagcatcggggcggttattgccctcgttatcggtggtgcaggaatggctattcccgaaatgagtatgcttgccagtatattcaagaaaaaactggtaggcatgatagtggcggttatctttttaacggcagttatcgcaggttatgtatttaacctgtttttataatcacttaaaaataaatagttcaattatggaagaaaaggaagataagaagaaaggcttttttgcctctctatttgctccgaaaccttgtaaatgtagttgcggagtgcaaatagaggaagtagaagaagatggaaatccgtcagagaatttgaaaaaggacgaaaccaaagtatcagaaaagaatgatacgagtgaaaatcaaggtaactcttgcggatgctgtggctaaaatcattcatcaatattctgtttgaaaggaaactaacttaatacaattttttaattggctatctaatgtaggaagtatgctcacatactttctacatttatttattgtatattaaaatataaaaataaacttctatgaaattactcccatccctaatacggttaataataatatataaatcttctttatcataatctcttagtatttttataagttaacagataaacccatagtaactgattttgttagcggataggcttcaccccgcggattgccagtttccgggtcccatgttttgaacttagaccatgtaatcaggtttgatcctgcaatatagatacgaatattattgaagtgcagtttattgactatgctttttggcaaagtataaccgatatccagattcttcaaacgaatatatcgaccatcacgcatccaataagtagaggtttgttggttgtttttattttccccataagttaaacgcggatatgttgcattggggttctcattagcatgcaatcccagtttggcagcagtctctgaatctacccaacgatcacttatcatatctttaaagatatttccccagtcactttcgctgaatgcatatacacacttaccataaatagggaaagtggatttaccggcaccttggaagtgaacatttacatcaattcctttccatgcgaaagatgcccctataccatatactaagtttggagtggtagtagcgccaatagcaactttatcattatcgtttacaacaccatcaccatttacatctttatatttgatatctccaggctgcactgtaccaaactcttgtttcgggctggtacgaatatcatcgtaatcagcaaacaatccttcagctatcaatcctttaacttgatctacacgataccctttttgatataaataagaatagacttgattctcttcatccttttcgagcacttcattcttactataagttatattcccacgaatagtcatatccacctcacccagtttctgcttaagagcaaaattgccatcgaaaccttgagatttcacttcacctacattcgctttaggtttgctctcaagacctgtaatgtcaggcaagaactcacgtgttaaaaaaatacctgtacgtttttcgtggaaatagtcaactgtcgctgtaaatttgtcattaaacaaagaaagatcaatccccaggtcatccttagtcgcaacttcccaagtaatgccattagaagccatctgtgtgtaatgagttcctatgaatgattttccataatcaccaaatccccagttatatacataattaggcttgccttcgctgttatatcctgtagtggctatagtatataagtatgggaaacggttgttatccccaatattatcattacctaccttaccatgagaataacgtattttaaacatattcatccacttcaagttattcttaacaaatgactcttcggcaacgttccatgcaagagaaaaagccgggaagaaaccgaattgatttcctggtgcaaaattttccgatccggtataaccaaaattaaaatcaacaaagtaacgatagttccagttataagtaaatcgtcctgctaacccttgattacgttttgatactccattcttaatatccgtaccaatgtctactgtccgcttctcactatcttgtgtgtaacggaaagtaactcctccatgatgatttccgaaagcacgttcccagcttaacagtaaatcaaggaattcacgacgtttgccagagctaccacttgattgtgtcatgtcatatgcggagaacattttctcataaataatctctcccgtttcttgtctacgtccgttcgctttatacaaatctggttgacgatgacgattaatccagttactgttgtctgtatcatagccaaaacgtcctacaaacttcaatcccttggtaatgaaatcaaaattttgttctaatgtaacattagtttgtacattattctgccaatcttcattgtatccagtttgcgtagatgcaacccagggattaagtttgtttacgttatcccggtgggaaataggcgcatatccattggaatagtatacaggcgttgcaataggattgtatccgaaaagcatgccccataacatctcgttatcagccagtcctggactattacgtttggctaatgaacctgctatacctagtttcaataaagtcgatttggtgatatctatatcaacattcatacgataattccactttttatagttggcatttgtatcgtaatcatcacgtaacgtttggtctgtgttatacataccttgatcttccgtataacttgcagaaacaaaataacgagcagtgttaccaccaccattcatgttcaagttagcgcgataactccatgctccgttttttaggatcaaatccatccagtccacattcggatagaaatccggatccatttgtgtacgaaataactctaattcttccggttgataggccattcctaaattgcgagtcactaatgcttcgttcatcagactggcatacgaaagaccgtctacaaattccggagtgatagtacgcgtattataagaagtttctaccttggcatcaatattgatttttccagctttaccacgttttgttgtaatcaatactacaccatttgcacctttagaaccataaatagcagtagctgacgcatctttcaatactgtgaatgattcgatgtcttcaatgttaagttcatccaaactgctacgttcaaagccatccaccagaatataagcacttgaactagctccaaaagtagaaataccacgtatccaaaactcagaagtactttttcccggttgtccggaagtttgtcgggcaataatacccggaacattaccggccaaagcgttagacatattggaagtagggaaacgttttaaatctcccacattcacattggttacagctcccgtcactgtcagttttttctgtgcccccataccagttaccacaacctcatccagtacactagcctctgattctttcatctttacattaacagtatgctgttcttttacaagtacttccacatcatcatatccgatgtatgagaagactagtcgatgataaggttccatctttatagaaaaattaccattgatatccgtaatggttcccaaacctgctacatcctttacagtgatattaacaccaatcatcggctcatcttgtgtgtcggtaaccgtaccagtcacggtaattgtttgttgtgcagaaatcgtcaatgggacaaccagcatcaacaaaaaaatggctaaatattttttcataatctgataaatgtgtttattcgttagattccactgttgattcatcttccggtatattctcgtcaccggctacattctcttcttgctccattgaaatagtgcgaatagtatgtcccacctgatcatgtacataaaacatctctttcacatcatcataaacaagtccacttacatcacggaaacgagccacttctcgtaggtcaccatcatcagttccccattggtttccgtcagctaaggaagttgacgctcctcgtcccgcataggtcgatacgataccttctggagttactttacgtacacagaagtttaatcgatctacaaaatagaaatcatactcttcttcaccagtataatccggatttttcacaaatactccttgacaaggattattcatacgtgcctcagttcctacatcatccctataacctgactgtttatatcccccgacaaaattatacggggtaataaattccttttttatctcgtcatagtcggaacgcatgaaataatgattgttaatcacaccaaaataagcatactttccagtaggatgaatgaaaatctgaaattcccaacttgggtcagcaatagtgaataactgcttaaaagtattaggattgttctttactataggatcccaacttccaccattcttaatagttttaaagtaatcaaccaagtctaaacgaaatacttgtcccttttcataactattaaaatacaattctccgttgattggatgaatagtagctccattacattgtttgtaagcagctatcaattgtatatcagatctatcatcgaatgtaccatccgcattacgtttaataatatatacactaggactttcatctcccttaccatcataatcaatagctacaatcatatattctgcctcatcagcatatccttctatcttcttattgaaagcaatgcttcgtatacgattagtaggtatagtattgatattcaaaggagaagaaagcatacgattttttaaatcgatcaactgtatagctttatgtccatcgtaacaaatatacaaatgatccttattcaacggatcaaaagctaatcgtccgttatcgctaaagccacagcatttgacaccttccggtccatcaaatggtccgtctctccaaccttgatcatcacgattattgcgatagccacaaagcgtacctacaaccatctttttctcatagctaaaagtagtactcgcagtcgttgttactgcattctctccttctcctacagtgatttcaatttcaccactaaaagctcctgaaggaacaaaacagtaaacataagtactttttacattaataacaatagcatctttgccaccaatcttcacttttaccttcgaaacatctgttccgaaattttcaccataaatcaatagtttctgataggctcctccttctttcggagtaaaatcagaaattgctacaggttttgatggatcaaaggctccagtctctacattgtcatcgtccttacaactacaaatgcaaatcgtgaataatgccagcaatatccaccgccattccttcaatacttttttcattttacatttcatgtttttcattctagttaataataaatgtatagttaattaaacatttcatcgagttttgtccattaacacttgcatccagtatcctccaataaccgaacgcgctttaaacccaacccattcaccactgtctgtgtgatgccaatcactgataggtacccgcgaagtagtttcattgatatatttatagagtggatctatgaatttcttgaaagtttctaaatctgaagacatagcagctgtccacataatccagtcagactttgtatactctttgcgggagtccaatggcaatccgtaaggattctgtttcgtcaaataatagttaatttctttgtcgattacattatttgggaataaattcaaattccacattttgtcccaaatcatattatatttctgactccaggtattctcacggtcgaaagcaaggcggtaatgatcaccttcatttgccatttcttcccatttcaccgccattttcttggctatacctgcatatttctctgcaacatcatataaaccaagcatatgcgccatttcgctatatccggctacacccatgatcgctccttattaattattatagaagcctgtggtgtcatcagattttttacatcagtatttgccattttacgtttgtctccatggcttcttgagaagtttattaaaaaaagagcataaaaaaaggctatctatcccagacagccaatctttttgttaaccttaaatctaatactatgaaaaacacattgcaaatatacggagttttgtgatatctgcaaataaatcgggctaaatggcttgatttataacattgattaaataattgaatgtttgattcaatgtttattaaggttttggagggcggaagcgtgtcttcttagctatttaggaatctgtaaggtatccagtacgttgggggaatttacctcttccattaggtgaattcccctaaacaagtaggaattttcaatttcataaggagaattcattccctacttttgtaatatcgaaagataaatgataggattaataaaggaaccattaaaaataaaggaatatgaaaacgaacgcatttagatacttaggactggctttaatggctgtgttaacgttgagtctgacttcttgtgaagtagaaatcgatagtttttatgatgatgataatatcggtggtggttactataatcgttcttctgatttatgtagccgtacatgggtgagtttttatcgggatgtggacggtaaccgttgccgtcaggaactcgacttttatttggaccggacaggcgttgattttattcgggtggaatatcctaatggacatgtggagacattcgaatattatttccgttggaactgggagaattatgcacagacttccattcgtatggattacggtcgcaatgatgtatcttacctggatgatgtatacatcggaggaaatcgattgagcggttatctggatggtcggaataatttcgtagaatatacaggtaggtgagataacagccggcagatggaaagtgccggcaaatgaaaagaaaatgatgattacacaaaagatgacaggtagagagatttcggataacgacaggtagaaagataccacatggaataggttgaaaaggtaaaaagcgataggtggaggtgacaggtaaaaagattgcggataacaaacagataatttaaaggataacatataagatttcaggatattaagaatttagagaagagatagggcgcgaaatgaaagcttaaaagttttgaatgggactaaatagtttttatctttgcgccctattagtatgtttaattcatggagtggttatataatctgtttctcgaacattctgccttacaggcagttgtggtgctttcactgatttctgcgattgggctggggctgggaagagtgcatttctggggagtatctctgggagtcacttttgttttttttgcaggtatccttgccggacacttcgggctttcggttgatccacagatgctgaattatgcagaaagtttcggactggttattttcgtatattcactggggcttcaggtagggcccggtttcttcagttctttccggaaaggaggggtgacgctgaatatgttggcgttggccgtagttctgttgggtactttgctgactgttgttgccagttatgcgacaggtgtgtctcttcctgatatggtgggtatcctttgcggagccacgactaatactcctgccttgggagctgcgcagcagacacttaaacagatgggcatagagagcagtactccggctttggggtgtgcggtagcctatccgatgggagtgatcggtgtgattcttgccgtactgctgattcgtaaattcttggttcataaagaagacttggagattaaagaaaaggatgatgccaacaaaacctttatcgcagcgtttcaagtacataaccccgctatttttaataaaagtatcaaggatatagctcagatgagttatccgaaatttgtgatttcccgtttgtggcgtgacggtcatgtcagtattcctacctccgacaaggtattgaaggaaggcgaccgcctgttggtgatcacagcggaaaagaatgtcctggctctgacagtacttttcggtgaacaggaagaaaatacggactggaacaaggaagatatagactggaatgcaattgacagcgaattgatctcgcagcgtatcgtcgtaacccgccccgaactgaatggaaagaaacttggctcattgagactaagaaaccattatggaatcaatatcagccgtgtgtaccgttcgggtgtgcaactacttgccactccggaactgattctccagctgggcgaccgcctgacagtagtaggtgaagcagcagccattcagaatgtagaaaaagtattgggaaatgcagtgaaaagtctgaaagaacctaatcttgttgtcatatttataggcatcgtattgggattggcattgggagcgatcccgttctccataccgggaatcagtactcccgtgaagctggggctggcaggcggaccgattatcgtgggtatcctgctgggaactttcggcccacggatacacatgatcacttacactacccgcagcgccaatctgatgctgcgcgcgttggggctttccatgtatctagcctgtcttggtctggatgccggtgctcatttcttcgatactgtcttccgtccggaaggattgctttggatagctttgggagccggtctgacaattatcccgacggtcctggtcggctttgtcgctttcaagattatgaagatagacttcggcagtgtatccggtatgttgtgcggcagtatggcgaatccgatggcgctgaattatgccaacgatacgataccgggtgacaatccttccgtcgcttatgctacagtatatccgttgtgtatgtttctgcgtgtgatcattgcgcaggtgctgttgatgtttttattgggctgacgatgaacattaaaggctggaatttgtaataagtagatgataaatcgttatatttatagcgataaacgataagtcgataaatagcatattgtaaatagtaaaatagtacatataatgactgctcaaagtaatataactcctgaaagcatagttggcgatctccgctacttgcagttgctttcccggagttttcctactattgccgatgcaagtacggaaattattaatctggaggctatcctgaatctgcctaaaggaacggagcatttcttgacagacatacacggtgaatacgaagccttccaacatgtgttaaagaatgcttcgggtgcggtaaaacgcaaagtgaacgagattttcggcaataccctgcgcgaagcggagaagaaagaactctgcacgttgatctattatccggaagagaaaattcagctggtaaaagcccgcgagaaggatctggacgactggtatctgatcactctgaaccagttggtgaaggtttgtcagaatgtatcttccaaatatacccgttccaaagttcgaaaatccttgcccgcagagttctcttacatcattcaggaattactgcacgaaacgtctgtcgagccgaataagcacgcatatatcaatgtcatcatcagcaccataatctctaccaagcgggcggatgactttattatagccatgtgtaatctgattcagcgtctgactattgattctcttcatattgtgggtgatatatacgaccgtggtcccggagcgcacatcatcatggatactttgtgcaattaccacaacttcgacattcaatggggcaaccacgatatcctgtggatgggagccgcttccggcaatgacagttgcatagccaacgtgatccgtatgtccatgcgctacggcaatctgggtactcttgaagacggttatggaatcaatctgcttcctctggcaacttttgccatggatacttatgccgatgatccgtgtaccatctttatgccgaagatgaattttgccgacaccaattacaatgagaagactttgcgtctgatcacccagatgcacaaggcgattacgatcatccagtttaagctggaagctgaaataatagaccgtcgtccggagttcgggatgagtaaccggaagctgttggagaagatcgattttgagcgtggagtttttgtgtatgaaggcaaagaatatgccctgcgtgacacaaactttccgaccgtagaccctgccgatccttatcgactgaccgacgaagaacgggaacttgtggaaaagattcactattcgtttatgaatagcgagaagttgaagaagcacatgcgttgcctgtttacgtatggcggaatgtatctggtttccaattccaatcttctttatcatgcttcggtacctttgaatgaggatggcagtttcaagcatgtcaagatacgtggcaaggagtattggggacgcaagttgctcgataaggccgatcagctgattcgtactgcatactttgatgaagaaggagaggatgataaagaatttgcgatggactatatctggtatatgtggtgtggtccggaagctcctctgtttgataaggataagatggcgactttcgaacgctattttctggaagacaaggagatacaaaaggaaaagaagggatattactacacgcttcgcaatcgtgaagatatctgcgatcagatattagatgagttcggggcattgggacctcattctcatatcatcaatggtcatgtgcctgtaaagactattcaaggagaacagccgatgaaggcaaatggcaaattgttcgttattgacggaggattttccaaagcctatcagccggagacgggaattgcgggctatacgcttgtttaccattctcacgggatgcagttggtgcagcacgagccgttccagtccaggcagaaagccattgaagaagggttggatatcaagtcaaccaactttgtactggagttcaattcgcaacggatgatggtgaaagacaccgataaagggaaggaacttgtgacgcagattcaggatttgaagaagttgcttgtggcttatcgcatcgggttgattaaagagaaagtataaataagtaataggtaataagtattaagtattaggtattaaccgtagctgccatttagagacgcatctgtctgtcattcagacgactgtaaggaggaagaatctcttctttgtgactacaaaagaggagatccttcgacaagctcaggatgacagatacttatgctcgtcattatcgaattgtttcactttgataaagtgatgaaaactttgaatgacagatagatatacctctaaatgatagctacggttaatacctaatacttattacctaatacttattacctaatacttaatacttattacctattacttattaatcagctgtaattacagtatccgcattatatgctttacgagcatattttaaagatttataagtgagaggaaggtcgcataaagaggtcactctttcccctgtatttacaaaaaaatctcctttgattatttctaaatgataagtattcacttcaatcataaatcctgttttaaaactaaagtcagcataaatggaatctttatccccgcaaaatatgggaggcacagatacgtatgcaataaaattactgtcttttgatagtatacaattataatgtcgattgtagtctctaacttgttttgaagtaatgcatgttaatcgatcaccgccgggaatataatggaatacaaaatcgctggactgattaaatcgtacttggtttctatccaatgcatatccatcagatatatatccaccagaattgaataattctttagtttttttatcttcttgagaatatacttttgatatactcaaaagtaataatgataacaagactaaatcttgcagaactcgcatagctttttattaattgtagtattaattatagtaactgtaatcactgttagcagtaccattgtagtcactaatattttcataattataattcccgtaataactattaccatagccataactatcttcgtaattaccataaccaaaataaccataggcatagccgtagctttcctcatgagcaccaatggtagtatcaatgtcggctttttttattcgatatattgtggatatatccgaaatgtctacttttcttacctttttcccatcttccccctctagggttgggtcaaaataagagatttttccgttttcatctggtactgcaaagactataatagtatgtcctgtgccatcaggatttaccatagttgcaacttgataatagtctctgttagaagtcattgaacctggaactgtattaccaaatcccataacgctaaggacatttccaattaattcattgggaactcctcccattgctgtaggatcaagaccataaatatctttataatcattagcataatcttgcgcagatcgggagggatccatatggtgcatgcaattgaataaacaatcccaacttgtagttccaccatctccaccgttgcaacatctcatttccatttctgtcagtactggcatctctttccgaatctcatcaatgagtgctcttgttaatttttgcttcataagtattaaattttatttgtgtgattctgcaaatatagaaataaatttcgcatctttgcaagaaatataaatctttttttatgcaaacaagacaattcccctgggagtaccaaatggatgcaaaagactgtggcccagcatgtatcaaaatgatagcaaaatactacggcaaatactattcgttgcaatatttgagggatttatgtgggataaccagagaaggagtttcctttttggatattagctatgctgccgaaaaaatagggctaagaactgtagcggttaaggcgactatggagaatctgaccaacaggattccactgccatgtatcatacactgggaccagcaccacttcatagttgtgtataaaacaaaaaaagggaagatatatgtgtccgatcctgccaaaggcttgctttcctatccggaagaggatttcaaagacagatggtataaggaaggggaagaattcgggatgctgatggtactggagcctatggcaaacttcaagcaaatagaagctcatgaacggatcgaaagattcaaaagtttcgaaaaccttctcaactattttacgccatataaaaaagcattcggcatattgttcgctatcatgttgatagccaccggactgcaagcagtacttccgtttatctcaaaatctgtaatagatataggtatatatactcaggatatatctttcatctacatgatgctaatcggcaatattgttcttttacttagtataacgctgtcaaatgtattaagagactgggtcttgctgcacgtttctacccgtgtcaatatctccctcatatcggactatctgatcaaattaatgaaattaccggtgactttcttcgaaaacaaactggtcggtgatatccttcaacgggcgggcgatcatgaaagaatacgcagctttgtgatgaacaactccttggggatgttcttctctatcattacattcgttgtattcagcattatactgttgatttataatcctatgatcttttttatttttatagcgggcagtgggatttatgtagcatggattttcacctttttgagcatacgtaaaaagctcgactgggagtatttcgaactgaatgccaagaaccaaagttactgggtggaaaccatcgaaaatgttcaggagattaaaataaacaattacgaagaccttaaacgctggaaatgggaagctatacaggcaaggatataccggttgaatctgaaagtgctgaaaatcaataatgcacagtcgcttggggcgcaatttatcaatagtatgatgaatattgccgtcacgttctactgtgccatcgccgttatcaatggagatatcactttcggagtcatgatctcaacgcaatttattatagggatgctgaacggacctgtggcacagttagtcagttttatacaatctgcccagtatgctaaaatcagctttatgcgtatcaatgaaattcatcagctgaaagatgaagacgattcttcgcctgtgataagcaacagtctgagtttgcctgtagacaaaagtttatatctgaagaacgtatcatttcagtattcgagaaatgctccgctggttttgaaaaacatcaccttgcagattcctaaaggaaaagtgaccgctattgtcggagacagcggatgcggcaaatctactttacttaaactgttgttgcgtctatacatgccttcttacggagaaatctgtatgggagatatgaacgtgaataatatcagtcttcgcaattggcgtgctaaatgcggctgcgtgatgcaggacgggaaattgtttaatgacaccatacagaacaatattgtactggatgatgccaatattgattatgaggcattgcagaaggctgttgaagtagccaatatcagccacgagatagaagctatgccgcagggataccagacaatgatcggagaaatgggcagaggtttgagtggagggcaacggcagcgtgtactgatagcaagagcgctctacaaggatccggactatctgtttctggacgaagctaccaatgcacttgatacgattaatgagcaaaagatagtaagggcattaaataacgttttcaaaaacaggacagtcattgtggtagctcatcggctaagtacgattcgcagggcagaccaaatcatcgtattaaaagcgggaatgatcatagagacaggcaatcatcaaagcctgatgacaaacaaacagtattattacaacttaattcaaagccaatatgaaccggaaacaaacaccttctccacagaagaaagcgcagactaaatcatccggaagaagcgaagaactggatgagattattgaccggatgcccatggctttcggaaaatgggtggcactggcggtcattgtatttgcagcattatttctattgttcggatggattatcaaatacccggatatggtgaccgggcaaattaaaattaatgcgcagaacccgaccgtaaggcttgttgccaacagtacggggaatttgctgcttctttcgcacaaagcacaggaggaggtgaagaagggggaatatatagcggtcgtgcaaaatcctgcttctacagaggatgtgcggaagattgcggatttaataaatcgaatagatttcgatggcacccatttgcttgctcttaaagatacatttcccgacaaggtatatttaggagaaatcaaccctcaatactatgcctttcttgcagctctgaaagctcaatgtgactatctgcagcagaatgtctacgaaaagcaaagagagaatatcacgacgagcattgaatggaaaaagaagattgtccgagaagcggaggactcgcagaaagctgcaaaagatagaatggatgttgcccggaaatggcttaaacgttatgtctctcttgatcagcaggaaatagcgacttatgaatatgagaccgatcagattaaaaataattacctgacaacagtacaggaggtacaaaacataaatagggagattgcctcgacccgcatgcaaatcacagaagcataccatcggctggagcaactggaagtggaacaactggagaaagaacgggaactgaaagtggaacttttgtccactcatcagaacttgatagcaaatatggccgcatgggaacagaaatatgttttcaaagctccttttgatggaaaagtagagttcctgaaatttatttcagatggtcaatttgtgcaggcaggagaagcggtatttggagtgatacccaaggaaaaccatatatatggtcaggtgctgcttccggccaatggagccggaaaggtaaaagaaaacagtaaagtcgttattaagttagagaactatccctacatggagtatggatatatagagggatatgtatcttctatttctttggtcacccaaacgcagaaaacaggagaaaagaccattgaaacatatttgattaacgttgaattgcccaacggattaacaactaattatgaagagactctcgactttaaatatgagttgggaggaactgccgatattattgtaaaagacagacgattgatagaacgcctgtttgataatttaaggtatcggactaaataaagctcatactcaaatttacgctccataggaattcaacacgacttttgccctcatgctctaacagtccgtctgtatccctttattcatcgtggtttcgggcgtggtagcaagtgtggtggcaagtatgagagcaaacggttgctctcactcagtttcgtcgcattatatgttgttttttgctgctattatttgatttacagagtattaatgtctgaagtgtcaactattaacgattggcatttcagccattaataactgagaaatcaggtgttaatagctgataactcacgcattattgaccgatatatgattgaatgcttcctgaaagatcaggttgattgaaacatttcatgcggtcaaatcaatccaatcatataagtcaagcgccagtttcctgcttgggaaactggcgttcccttataagggaacgccagttccaaggcaggaaacgagcgtttccgatatagggaacgctcgtttccaaaataagactgatgtgtactggttttagttgacaacttcgtttgttataactgaattagtttactcaatatactttaatatctaaataggtttacttttgttattcttattcctatgttagttgtcttttgtttgcaaatgtcggttaatattgtttctacatcaagctctattcttggtattcgatgttctattttaactattttatatgcacgtgtatttgaatagataactgtaatgttctcttttaaataatagatgttctgtttttcatattttaataaagaacttggaggaaattcgaatggaaaaagatatctttgtggaactaaatttcttaattatgatcatagatgatgctcttcccaagtttgaccttccggtcgattttgttacagatgacagcataaccggtgatattctgaatcaatacggtcgttttccctgccatataaaggcgggagtctttgttctttgcacgcggggaactgtacgtgccactatcaacctgtccgagtataccattacccataatgactttgtgactgtcctccccggatcattcatacagattcacgaagtatcttcggatacccgtgtctgctttgcgggcttttcttcggaatttatctcccgtgtaagttatgtagagacctatctggattttctccctatgattttggacaatcctattatggcattacaggaagaggtagcgcaattataccgaaacgctttcagcctgcttatccgtgcctattctttaccgaacacactggataacaaagaaatattaatgtctatttttactatattctttcagggggtgggtgagttgtataaacgctgtaagccgactactaacgaacctatcaagcgggaacatgaactttatcgccagtttatccagttgctgatgactcactatacacaggaacacgaagtttctttttatgcgaagaagtgcggagtaactccggctcatttttccggtgccatccgtaaagccagcgggcatagtccactggcgattatcacgggaattattatcatgaatgccaaggcacaattgaagtcaacccgattgccggtgaaggaaattgctttttcattaggatttaataatctttccttttttaataaatatttccgtaaacatgtgaaaatgactccacaggaatacagggaatgctgaatgttaacgatcggatacatttttcgttcatacgcagttttctttctgtggaaaataaaggcagtttaccgataagaatacccgattcattgattttttttcttattcttctctttccggcatatatttgtaattgcgcaattataatatgataataaagggaaattatgaaaaagaatgtactatttttaatgttgtcctccttgctgttgttgtcggtaagctgtacgacggattcgactgagtttgacgaggggaaatggggaggcggttcggatgaagaaggaggcagccagcccaatcctactgttcctgaagaatcggatgatttgctgaattttacgattgctttcgatgaaagtgatcggacaacttacggcagtatgtcagagactgtggtgacggatgaaaatgatgcgaattatgatgattttatagaaaactcatcattcacttctgtagttactgtcagttatgacggggccacggctactgtcagcaatgaagttgatggggtaagtgtttcgcagaacggagcgcatatagtagtgaactctacggtcaagggaatagagtatgtcttgaaaggtgctacgacagacggttcgtttaaggtatatagtgaaaagaagttcaaactgtcattgagtggaacgtctattcataatcctgtgggtgctgccattaatattcagtcatcgaaacgggtatttgttgtctgcgcggagggtacgaccaatacactgaccgacggaacatcttatacactgactgacggagaagatatgaagtcctgtttctttagtgaaggacagctgatattcagtggaagcggttcgctgtcggtaaccggaaattataaacatgcgatagtcagtgacgaatacatacgtctgcgtagcggatgcaatatctcggtaccttcggcagtgaaagatggaatccataccaatgatgccgttatcatcggcggcggagtgttgaatatctcttctacggaagacgccatccaatgtgaagacggaggaatcacgatgacaggtggttttgtcaaagttgccactacggctgataaagcgcatggttttaaatcggagttagatgtgataatcagcggaggcgctcttcaggcggaagttacgggagccggttccaaaggaatttcgtgcaatggaaacctgacggtttccggaggaaagataaccgcattcacttctcagaaacctctttatgaagatgatgatctgagttcgtgtgcaggaatcaagtgtgatggagatatagtaattgaaggaggcgaaatagctcttcaaagtacgggagctgcgggcaaaggtatgaattgcgacggttctattactatccatgacggtacggtaaaagtgatcactaccggtacacagtatgtatacggcaagctcgattcatcagctaaagcaatgaaagcggaaggcgcattgaccatcaacggaggaacggtgctggtaagagccacgggaggagagggcagcgaaggtattgagagtaaaagtgtgctgaccgttaatgatggtatgattgccgctctctgttacgacgattgtatgaatgcgagtaacagtattgtgatcaatggcggaagtatttattgctacagttccggcaatgacggcatcgattccaatggtacgctgaccattaccggcggagttgtgatcgcttcaggaactacttcgcccgaagacggtttcgattgtgatcagaatacgtttaaaattaccggaggaattgtactcggcataggcggggggacgagtactcctacttcaagtgtgtgtacacagcgcagcgttatttatggcggttcgggatcgaacggagaaattctgaatatccagtctgcggatggtaccaatgttctgacatatcagattccccgcaattattcccagatgacgttgttgttcagtagcccgaacctggcttcgggaggcagctatacgatctccaaaggcggttctgtttcgggaggcagtgagttcttcggactttatacgggaagttcttattccggtggcacgcaggcggctacctttacagccggttcaatggtgacgcaggtaggaaatgtgaactccaatccgggtggtggtcagcccggtggaggaggacgccccggaggatggtaaaatagcagtttaccgttgaaataagtcctttggtcgattatttttgtggagaagaagtaacggttctatctttgtatcagtaatttggaacaatgaagcatggaaagactgcgtaaacaacaattgctggagcagagcatttatggggctatctggacagttatttttcttctcccactgataggcggatactttgccgtcagtggtggactcgaaaaagaagaaatccgtgtaattgttcatgattcatggttgagcatccttccttttttcgtcttgtttttgttgaataattatggattagttccatatttcctgtttaagaaaaagtactggcaatatattatttctttggcttttctaatctctactgcttgttgggttattcccggtccctctatgcagcgttttccaaaggaattcagatatggcgatctacgcaagggtaaaggaaaaagtcagagagacctgattattaagatgagagagaaggctcgacaggaagagtctgttcattgggaagcgcctcaggcaaacgatccggttttggaaaaaccgcaacgaccgggcggcttccctaaaccgactccttatcccattcctcccttcaccatccgttaccttattcattgtgtaattgcctttttgatggtaggatttaatattgccgtcaaactgttttttaaatcctttcgtgatgaagaaatgctgaaagaactggagcatcagcgtttacagtcggaattgcagtatctgaagtatcagataaacccgcatttctttatgaatacgctgaataatattcacgctttggtcgatatcgatacggggaaggcaaagagtacgattgtggaactttctaagctcatgcgctatgtgctttatgaggccagtaataaaaccattctgctttcgcgcgaggttcagtttttggagaattatgttactttgatgagtttgcgctatcctgagaaagtttctattgaaaagaatttccctctcgaagtgcccgaagttcaaattcctcctttactttttatttcttttgtggagaatgcttttaaacatggagtgagctacaggaaagagtcatttgttcatgttgtgatgcaactggaagaaggaaaccgccttgctttcagatgtaccaatagcacggggacttcgtctgacgagcaacatcacggcatcggtctggagaatatacgcaaacggttgcggttgttgtttggtaatgattacactctctccattactgaggaagatgataaatttgatgtcttacttattatacctttattataatgaaatgtatagcgattgatgatgaacctttggcattgaagcaattgacggattatatatcccgtgttccttttctatctttagtcaagtcctgtcaggatgcttttgaggcgatgaaggtattggcagacgaagagattgacctgatatttgtggatatcaatatgcccgatttgaatggactggattttatccgctctttaatcagccgtccgatggtggtctttactacagcttattctgaatatgcggtagacggtttcaaactggatgctgtcgattatttattgaagccgtttgaatttcaggatttgctgaaagcggcggataaggcacgaaaacagtacgaataccgaatgttggaacagcagggagaactgggaaatagttcgcagattaaaggagattccttgtttgtaaagagtgactacaaagtggtgcgcattgatgtgaaaaatatccggtatattgaagggatgagcgaatacgtgcgtatctttatagaaggagaggataaaccggtcataacccttgccagccttcaaaaaatggaggaacggcttccaacgtattttatgcgggtacatcgttcttacattgtcaatctgcgtaagataaccgaagtttcccggcttcgtattatctttgatagaaatacatatattcctgttggtgataattataaggagagatttgcggagcatatcagtaagctgagtttctcttagaatgttttttataattacattttgttacgtcttataattgaatgatattatgcttgttttgaaaaaaatgaatattcacattctctttacacattggtttttatctgatttcccatttctcaccgaggaacaccctcttggttttaaaggaacggcccgttggttttaaacccaaaataggtatttataaccccctaaaactgatatcaatagaatatatagttttttcttcatgttgtttattattttataaattaacacttatacccatagttatcgattttgttaacggatatgattcacctctgggatcgcccatttcaggatcccaagtcttgaaactagaccatgtcaagagatttgttcctaccaaaaaaatacggatattattaaagtgcatcttgttaacaattgatttggggagtgtataaccaacatcaattgtttttagtcgaaggtaacgaccatttttcaaccagaaagtagagtttcggtagttattattgctggcattgtcaccttggtagctcaaacgtggatacgaagcattaggattttcattggcaggaatacctaatgtttcagctgtatcagcatctacccatcggttgtccagcatacctttaaaaatatttccccattcgccttctgtaaaggcccatacacacttgccataagtgaaaaatgttgatttacctgctccttgaaagtggacattcacatctaaacctttccaagaggcagatgcacctaaaccataaatcagatttgggcggctagttgcaccgatagctacctggtctccatcattgatcacaccatcaccgttaacatctctatacttgatatctcccggttgtacctttccccaactttgtgtcgggctattgcggatatcatcgtaatctttgaataatccttctgcgattaatcccttgcattggtccacacgatagcctctttgcatctgataggcatatacattattctcctcatctctttccagtacttcatttttactataagtgatattgccacgtacagttaagttcacgtcattgattctctgtttgtatgagaagtgtccatcgaaacctttagaacttacagcacctacatttgctgccggattatgcccgttcaaaccgacaatctgaggtaagtagttacgaaccatataaattccggtacgtttttcatcgaaatagtcgatcgttgcagtaaatttatcattaaacaatgcaaggtctatacctaagtcattcttttcagcaacctcccaagtgataccattggaggctacatctgcaaatcctaaaccaccaaacgaataacttgaaggatattgtgcccaatcgtatcctccataaataatctcattatccccgtttttataacggtctgcaatagtataaagataggggaatcgcgttccgacattatcattacctactttaccataagagaagcgaactttaaacatattcatccatttcaaatgttttttgataaacggttcttccgcaatattccatgcaagagaaaaagcagggaaaaaaccaaaacggtcgcctttggcaaagttttcacttccattatagccaaaattaaaatcaataaaataacgataattccaattgtaagctacacgtccggccaaatcctgattacgtttgttaataccagtcttcaaatcttctcctaaattctgtgtctgaatgtaagagtcttgtgtatactttatagtagcgctagggtgatgagctccaaaagaacgatcccagtttagcatcatgtctaggaattcccgacgattaccgctagaactgctttcctgtttcatgttctgagaaccactgatcttcttccatcttaattcaccagtttccggatctctggcacgttctgccaaccattgttctggccacttcagacgacggatcgtattttggttgttgctgtcatagccaaaacgcccaacgaactttaatcctttagttatgaaatcaaaattttgttccaaagaaatatttgtttcaatattatttgtccaattttcattgaatccagtttgggttgcagctacccatgggtttgttttattgccggatccaatagctggtatatatccgttggaatacataacaggggtcttaattggattatatccgaaaagttccccccaaacatcaccatcacctaatcccggactattacgtttggataagaatcctgctaccccgactttcaataaggttgtttttgtaatgtcaatatcggtattcaagcggtagttccaacgatggtaagctgcattggtattataatcatctttcaaagattcatctgtattatacataccatcttctttcacatagctagcagaaacaaaataacgggctgttgttccacctccactcatatttaagttaatacggttactccacgcaccgtctttgagtaacatgtccatccaatccacattcggataaagatccgtatccaagcctaaacgtaagatgtccaactcttctggtttatatacagcctcgttgttacgggtaattcgcgattcgttcatcaagctggcataagtaaatccgtcttcgaactttggagttacagtcctcgtattataggttgtttctactttagcatcaattttgattttaccggcttttccgcgtttagtagtaatcaatactacaccattagcacctttcgaaccataaatagcagtagccgaagcatcttttaatacagtaaacgtttcgatgtcttcgatattgatttcatccatactgcgttcgaaaccatcaactaatacataagcagatgagttggcaccaaacgtagatataccgcgaatccagaactcagatatatttttacctggctgtccagaagtctgacgcgccataatacccggtacattacctgccagtgcattgacaatgctggaagatggattacgtttcagctcaccaacatctaccgttgtaatagcacctgtctgtgttagttttctctgaactcccgtaccagtaataacgacttcatctactgctcttgtcacgctttctttcataacaacgtttattgtacgttgttctttaaccattacttctttcgattcataaccaatataagtgaacactaactggcggtaaggttccatggttatggagtaatgaccgttcatgtctgtgattgaacctaaaccgggcatgtccttcacggtgacattcacaccgatcaacggctctttggcttcgtctgtaacaacacctttcacaacaactttttcttgctgcgccataaccgttgaacaaaggcacaacagcatgatacataatgataaatattttttcatattattcatgtgcgttttaatcattagttattcttctccttcgtaagcaatcttacggatacgccgattggaaccatcaccgatgtaatacgtatcggttgcttcatcgtaagctatacctttcggacggtcgaaacgggcctcttgacgtaaatctccatctacatatccccatgggttaccattcagactggcgcttccgcgaccggcaaatgttgagacctttccttgcggggtaattttacggatacattgccccatcttatcacaaagaataaaatcgtattcatcttcttgccctgcatactctgggttctttacgaaaactccttgataaggagtattaaaacgtgcgcttgttccaattccgtctacataagcagctctttctgctgttcccgctacaatgaagggagtgacaaatcgtttacttgcccaatcataatttgtgcgctgaatatagtgtttgttaatagacacaatataagcataattccctgtcggatgtatacggatattatattcccatccattatccatttgaaaaagtacttctttatcagcaggagttgtacgtgtaccgtcgaaaatttcttgaatttgttgcttctctactttgaagaattgccccttatcccaactattaaagtacatatcaccatctaccggatgaaaagttactgtattacaagctttgaaattaaccaacgctaatctgtttccccacattttataattgcgctcatcgccctcaggggcttctctattacgtgtaaaaccatatacagctgctctcaattcgtctccttggtcaactgccacagccatgtgattttcatcaaaaaaggcaagtgcacgtccgcggttagtacctcccatgtcaccttctgtaagagccgttcctacatattggtttttgaggtcgagaatacgcatattaccgtttccttcattttcatcacctgcacctctatcggctgcaacgtacactaagtggggatatttagggtcaaattctaaccagttgggggaaccaaatgcaccacaatcattaaatggaccatcttttgtatcgtatccgccgtcatctctacgcgaaccacataatgtactcactaactgttttcgcacatattcgaacttggcctctgcgatagtagatactaccggattgtcgccattggatatttgtacttcgatttctccggaataagcctgtgaaggtaccaaacagtagatagaatgatttttcacattgattacgatagctttttttccaccaacaaagacattcacaatagacggatcattaccaaaattttctcctgatataactaatcgctgcccgaatccccccgtagtcggattgataccacttacttgaaccggaatattcggatcaaatgctgcattgtctgaatctccgttgctgtcattgtcatcactacaacttccgaagaatagagcaactagcagtaatgccatccagcatacccgccagtagtctttcatgattttgttttttttcatacgtaaaaaattaatgattaataaaatattatattgttggttcattacttatctcttgttgtattatgctgaaatgattcatccatgcgaaaaagtattctttcaacttattgtccatatttttaatgattcatcttatccattaacacttgtatccaatatcctccaattacggaacgtgccttaaatccggtcattctgccagttttggtatcatgccagtcactgataggcacacgtgaagtagtttcattgatgtatttataaagaggatctacaaacttctcaaaaatttcacggtttggagacatggctgctgtccacataatccagtcggattttgtgtaatctctgcgggaatctaatggcaatccatatagattctgctttgtcagatagtagttgatttctttactgattacattattagggaatatattcaaattccacatcttatcccagataatattatacttttgactccaggtattattgcggtcgaaagcgaggcgataatggtcaccttcatttgccatttcttcccatttcatcgccatttttttagctatgtcagcgtatctttctgctacactgtttaatccgagtatatgggctatttcactatatccggctacacccataatcgcttttattgaaagattggcattatgagcccaatggcctgcaaaatcatctgtacaaagttgattttccgggtcctgtccaaacgacccgcaaacacattaacatccatctaatacagattcgtcaataaataaattagcttttattgtttgattaataatattcaccaaacgtacagttaacgaagtacgcgtcgtaccctctgtcaatgtcaattctttagttttggatgtagacgcttcatttatatagactaaattatctataacatcatacttagcattttcacatgcagtatggaccagtgccagtaccccaaatgccattattttaagtaaagatattctcttcattgtttaaccctttcttttagttattaataggaggattctgtgcagcaatagctgcacgcactgtgggataatcaggatttccaggataatcatactcaatatgataagcccccatacctgcatgttctattccacaagccggatgatagctctgttgctcggtaaagtaatgcttatccactgctctttcaaaagttgcagtcacaatagatttccccatagcttctttaaagacattagggtgacttctacgtacagcttcaaagaaagaatccaatccagaatgtcctagttcataggtctgccaagctatataatcaagacttagaactgtttcctctgaaagcacttcataaaagctcaaccaacctgcaccaccagggatatcagcaaccaacattttccccgtcttatcaaactcctcacgtaaagtcttcataaacgcattgggtactgatggcatactggagttcattaaagtcccccaatcctcaatatcataatcaaatccatcgatattatatttgttacatgtatctacaatagcaagtgcatatttcttagcagcctcaatgcaagattgctcatctttaggatcaaagccccaaaacgcttccttcactgcatcatcgttaccccccggtgtgagattatcaccaatatctcctgcgcgccaacaaagcactgctctggaacccttagcctgaaagtcttttaaatcagcctgttgctcaaccgtcagatttccccaacagagccaaaggctcacaaaatccgtactgtccggtaatccacataaagcatattgcatggaagaacctcccttacctgcccagttaccaaaccagccaaacataatcttatgtggagagttaaaataatccttcaaattattttcataaccttgcgtaggaggttcataataatctttcgcctctatgtcggtccaatcactacatgcgatatttaagaatccctgcgaaaaaaagagagaaattcctattccgtatattatttttttcaatttgctcgttttcataataaaaattattttaacgttctgatttaatttttcttagcccaccaaagatctgtggcagagttatctgcaccacctaacattgatacagctgctttcacatttgcattattcgtattatattctgactgagggaaaggcaaacgacgcataccacgctgcactgtcaccccatctgtattcagattattcacgatagggaatagtttaggataacctgtacgacgaatgtcagcccacgtttcccaaccattcggaaaattggcaatccacttctgaatcaaaatacgctccaaattctctgtaacacttgctgattcattatatttcggagttacagttgacactgctgctatatccttacctgaatccgaaggatcactgtaagcagcaggaaccttttcacttttcaaataatcgccaatagtagctttacgttcttccatagacactgtcactcctgcgtcataaagttctttgggagttcctcccatattccatttatacatcaatgcagcttctgcacgtaaaaaataagcttcagatgcagacataatgagcaattcatcatctataccaatattcaggcgggagaattttgtataatttgcctgagttgtagcactttggtaaataccatttcgcactcctatttgtcctccaccgatagaagcatctgcttctgatgcatatttagccaaacgaggatcattataaccgcttaaatatgaagtgatattagcactgatacgaatttcattccatgaagaagtaacacgataatatggattcataccgtcattatatttactatatgcagcatctgatgcagatgtcatcacaccaattacatcagaaacagcttcttctgctttctccttggcaagtgctggagaaacactagaaatgcgcattgccatacgaagctttaaagaattggcaaatttcacccatttgttaaaatctccattaaatacaagatcgtattctgataaagaactcatatcttcattacctaacactgctactttaaaagcggaaatcgcttcatccaaatcatcaaacatgtgtttataaagatcctccatattgtcatattctacagtaaaagcagttcctgtaatttgagaataaggaatcggtccataacaatcactaattttaagtgaagctgccacacgaagaatctgtgcccattgataagccaatcctttgccatcagaaagatcacgtatctggaaatatccggtataaatctgtggcatagtagtatcaaacatatttccataccacccaactcttggattgtaagtataataattacctccattaccccattgggcgatacaagtaatttctccaccatattcagatccaatcatctgatccaacatctgtgaattgttctgttgtccttgtactaatgcaggaatcatgcttttaatcaatgatccggtgattgcattatcacccagcatttggtcaggtttaggtccaaagggatttgtattatactcttcaaatttatcggtacaacctgttcctagtgctactaacaaagtatacacagacagttttgcaaacttctttattatcttattctttttcataatctaaactagaatgttagtttgacattaaatccgagacttctcaaactaggttgttgaaaatagtcaaccccctgatagaaattactagtgacagaagatgtactttccggatcataaggtgctttacaataaatcatccataaattctttcctgtaagccccagtgtcatatttacatgatttttgaaccatgttttaggaagttggtagctcaagctcagttcagaaaggcgaatattcgttgcactatatgtataataagtaccaacagcagtagttactttactataatattcctcagcatccactttactgtctccaacccatacaccgcctgcctgacgagcaactgcagaactttcagatacaccatatttatcaatcatggcttgtgtatccgatacaactaatcctccaaaacgcccggtgaatgcaaatccaagattccatcccttccaagcaacactaccattccatcccaaataatatttaggaagaatagagccaaccttgcggtattccgtattttcaatagccaaacttccattagaggggtctttccaaatatatccattaggagactgacgcaaacgctgattgatataaatatctcccattgatccgttttcatagagtcttaaagtcggaccaccactagttcccaatgttccttttgagtaatactccatttcgatagcttcgccggtttccggattgatggcaccattcgctaaactaacgatcttgttttgattaagagtgtaagtgaaatttgtagataccttcactttatcaaatgtatcagaatatcctaaagccagctcaataccctgattctgaatattaccagtctgcacaatattattcttatatccagatgaagccgatgcatcaacatagaatgtctgattgaaggtattagaacgatagaaggtcatatctaaattaatacggttgccaaggaatttagcattgacgcctagttcccatgattttgtattttctggtttcagattagtattataatgacttgcaggatattcatatgtatttgtttgctcattataagtatattgcatttgggtaaggtatcgattaggggaagaagcgacctccgcccacgaaccacgaactttcaaataagaaatagcttttggtagctttacagattcactaacaagccatgacagaccaacagacggataaaagtaggaacctttgctggtaaaagctaattgagatgcccagtcattacgcccagtgacagtcaaatacaattgatgattccatcctaattctgcacttgcaaaaacactttgtacttgatcatgccattttgattcattacgcttggaagtattgacattaatattgccataatggaagaaattaggaatttgctccaatcctccctttagatacatagcatcttcctgaatatcattaatagaagcaccaacagttgcattcaatgaaagtttgtcatcaaagaaattcttatttatgctagccattacatcagcataaacagaccgatcattttgtttagtatgtccataataacctttagaactactttctgtaaaagtacctcgtgtactagcataatacttttcataactatcgctatctgaattatccacacgtactcgccctgttacattcacccaatctgttatatcccatttcagactagcattaaacatataacgacgtttagaaagctcattctgcattcgattcataatccaatatgggttttgcatatccaaatcagtaccaaatatagattccggccaatattgtaccataaggtttcgagcctcactatagcgttcatacatctgtacttcctgaaagttttcacctcgtggaaaaagataaagagataccaagggattaaaatattgtccactacctaccatattcttattattttgaataatatattgagctcccaaatcaagactcaacttattatcacagaatttagcggtattacgaatagagaaattatagcggttataagcattattaggtaagatacctgtagagtttgtagtagagacagatgcgtaagtttgattttgttcagtaccagtggtcaacgtgaaaccattcatctccgtcattcccgtattgaagaagtcagatggatcaaagttgctaggagtatccatcaagctcccccaactgcctaactctccttcacgattaccataaatattctgaaacttcggcatcatcatcggagatgaaaaacttgtactattactataagaaatttgcacttttcctacagtaccttttttagtagtgataagaataactccattagaagcatccgaaccatacaaggctgcagcggaaggtcctgttaaaattgtcatgctctcaatatcttcaggattaatatcagctacgctattagatcctggctgtttgttcatcgtacctccagcattatctcctgaatttacattaaacattggaataccatcaataacataaagtgcattatcatttttctccaaagactttgtaccacgcataactacacgagccgcagccccagcaccggctgaagaagcatttattgttacgccagctacttttcctgataaagcattaataaagttagcatcctttatattagtcaattcatctccctttacttgctgtacattataactcaacgctttttgttcacgtttgatacccaacgcagtaactactacttcgtccaaggtttgcgtgtcttcacccattgtgacttttaggggttgggcgtagattaccgcgcagtatgtctgcgataattaccaacaacaatcattatcaaagaaagacaattgtagttatataaaaaatagcaacaagtttatataaaccagcctatacgtttataataaattccatgatcgtttataataaacgtccccaccgtttattataaactccccaaatgaaattcgcaataaaatcattaagtttttaagacaaaaaaggctgcaaacttcataaagtctgcagcctttagcctatatctggtactctatcacctaaggtttctcaggaagatagtccatacttgttgctatattataccatttaggaatatgattttacttttttctttcatctgttttttataggtttatgctattgatctacaaatatacaacatttaaaagcgtttgtcaagtacctgctgcgttttcaaatatgcgttctttgcattaatgcccacctaaattcattttcatccatgtacacgacctgtcagcattactatgaactaatgtttcggtataggtctttgtagacaatgtggcacacaacctcatcgcatctttattaaatgaacgatttaaaggaatggtaaaagcaagttcataacctcccgacacaacagaaggagtgatttgtaatccttccaactcactattctcccatttccccttattaccttgccagacagttatatcgcctttatatgaacaccataccttataaacaccttcagcaggttctttcaaacattcattctttgtatcaagatagataaaaacaccgcttcctttttgagttccttgtccaccggaatacagttctccatccttaaccttgcaggtgatataaagattatctgcatctttcccgactcctaaacgtaaattacagattccggtatgaccaataaaaataggatagtttacaatatcagaagagttcacttctaaatcccgcattacatgtcctttcatgaaaaacggagcctccgtccccccctgatagttactggtagcaagagctgctatagtattcgcatcccaaacagctacagaaggccatactgcatgctttcccgcaggcacaggaaaagggcgcgtgcgccttacaaagttacgggcattcttgtcacctattgccacttccatggtactataaggcagcctgtcacccaactgatcgtcgtgacgtatatcatccacctgataagaaagtaacgtttctcctgtaggaagtacacctaaataaggagctcccatgtaaatccaatcttctacaggttcgcccaatgccatagcacgatttggagaatccgccaatacaggagacgaccaattatccgacaatttagtacgtacggtgtatggtttgaaagtaacaaacccacaatcttctatcacacaaacgatttcatcgccaaccaccttacttaccggcattccatcacgactacctgcgcgaaaacaaactgtcttataccctccccatgtcttaccattatccactgaggtcatcatggatatttcctgttcattagaatgagtatatggcccctcattagcaaaataaacttgcacctcttcattaggaagttgaagaaaagacggttcccaacaaccgtcagaaaaacgaggttccgcttcataaataatctgaggatcgctccacgttactccattatcagtactacggcgtaccgctatagcaaacggagttatttcgggtgtttgaggacgataattacaagcagccagcaaatccccattagcaagttgtataatttctgagttagcgatatttattcgggcagttcctttatcattcgttatactatggatggggaaaagaataacaggatccccccatgtactaccttcatctgtactacagcgcatttcatagcctgtatcatagttctcatatacagccaccactgtattatcctgtaaacggatggaacgtggatatcctcccctagttgccagttgccggattgttccataatcccaaccaatacgaacaccgtcaacaggttctccttttttagctaaataagggactcctggatcttctccggcaccatcagagtttccacaggccagaagtgtaagaacacaaaaattcaagaggctcaataaacgccttgtttttgttttcatgatatatcaacagttttatatataacaaattttcctccctaaacagataaatacctagggaggaaatacagttttatttattcccaatagggagattgtaccaatcctatccgcttatccatttcactctgcggtatagggaacagataatgtttcttttcgaatacacgagaatcacctactgttgaacgtttactataatctaccttattagtagcagttatattcataccatgcatatatccgttgtctgttttctctgcaattttccagcggtgacaatcgaaatagcgatgtccggcttcgaacgctaattctatctgacgttcatgctgaatacgttcacgcatcttatctttgtccaagccttttgccaatcccggcaaaccggcgcgtttacgaatagcgtctacatacttgtatacatcatctacaggcccttcagcttcattcaatgcttccgcataatccagataaagactacctacccggaaaaggatagaggcttctttcattcctcccttaccattaatcacatctacaccttcatcagcagtttttcgcaataagtatccggtacagcaataatctactttggagacattaataccatcttttccaccttgccaaaattccaattggcgaccacgccactgttgaccattaaaattgattgaagcataaaaacgaggttcacgaccgacatacatattataaactcctgccggataatgtttgccagccgttgccgcaaaaccagtttccgagtagccgcttgctccatttattataggcgttccatctgcattatatccgataatcggtgttgaaccattagccatttcataggcatcaaccagttcctgagtaggacaaagaccgctccagcctcccataccgttggctgccatacatttctcctgatggatattgtcactatagcctgtcccttgatttctggcaaagatatattctttattccatttttttgaaggtaggaataactccatatagtttctataaccgttatcaggttcatccgaataatacaaaccataataagaagaaccctctatcttatctattgcttctttggcagccgcagcagcttttccccatttagaatcatctttgggagcaaagagcaatgtaccgtcttcattggcaaatttagcataatcagcatttccattgaacagcggacttgcagcataaagcaatacacgtgctttcaaagcataagctgcggcttttgtagcacgcccatacaaagattcggccaccgtaccactcgcattggtataaatcatcggcaacgctccatcaatgccatattgacaatctgaaactataaaatctacgcattgatcaaacgtatttcgagggaaatatgtcatttcatcatccattttcagcgcatgatccatgataggaataggaccgtgactacgcaacagaaagaaatgcaacattgcgcgcataaaacgtgcttcacatatccacacattttttgtagcttgcgctgccggacataagtctatattttcaagaaacacattacattgacggataccttcataataacgccaccacattgcataagacgtaccctgactggaactaccttcgagcattttaggattccagctaccacgattcatttctttagccatcggataagtccaagtgatgttcatctcatcagatgcaccactccaggcacccaatgcccaataatcattatcattatagttagtttcacaaggaaggtaatcgtaagctcttaacagaaaacgttctgtataaatttcactggaaaacacttcctctaaggttatggaagtagcatcgtccggagttttatccagataatcactacatgaagtcgatacaaatgcccatgtcagcaaacatagtcctgccacctttattttcattttcgatattttcatattcatatttatttaaagttaatctggaaaccaaagttaatagttcgttgcatcggatagttacctacaccattattcgactccgggtctacaatcttgatataatcaagtgttaatagattttgtccgttacagaacagacggatattatccataaacatcttatcaatcagtcttcctttgaatgtataacctatttcggcactcttcaagcgcaagtaagaaccattacgcatatacattgtggaagtttggtagttattgtaactattagcattaagaacaataggatattttgcagtagcagctgtttcagatgtccaacgattatcatacacctcacgcagcacattccatgtgccctcaccattcaggaatggataaacagttgctccttccaaaaagaaacttgtcttggcagcacccgtgaaaaataaactgacatcaaaattcttatatgccaccgtaccaccaaatccaaacataatctccggagtacgcgggtcaccaatagctactttatcatactcatccactacaccgtcaccatttatatctttgtatttaatatccccgggacgaacggtactttggaacgtctgcttcgggctgtttttaatatcatcctgatccttgaagaatcctagtgccacaagtccgaatgtctggtcaatacggcgtccgcgagcatcttgatattcatacttcggcttcggttcatcattttcaataatcttattacgggcaaacgagaaattcccacgtaatgagtagaataatccgttagcaactctttttttcacttcaagtgcggtttcaatacctttattctccgccttacctagatttcctaccggaatacttgcacctgagaaaccagccaatacaggcacagttttacgagtaatcaagataccgtcacgcttttccttaaatatatccacctgcaaagaaaccacatcgttaaataaacccagatcaaaaccgacatttaactttttcgctgtctcccaagttacattctgattaccggtctgcccttccataatacctgccatataattattgccttctttccccatatatcctgccgacacattcatattcatggtagttagataaaggaaacgggtgctggaagaaatgtcgttacccaccgtaccataacttccacgtaatttcaagttgcttatccaccagttacggttccaaaagtcttcattcgtcaaaacgtatcccaatgatacggacgggaaaaagccataacgcttacctttcgggaactgttccgaaccgttatatccgaaattgaactctgcaaaataacgttgcaagtagttatagctggcacgtcccgcaataccctgacgacgataaggaacggatcccgtacggtccgtattacgcaagtttacataatcacgacggttgaacaaaaacattccagtaatattatgcataccaaatgtgcgatcataattggctgccacttcatagtaaatggcacggttggcactttccgctaaagtcacattcttaatattctcattacgaagtatattatagatggcattgccctccgcgtcttctcccatatactgttttactctttgtagtagttcacatgatactaaaatagcacagagaaagtgctgaacataaaaatcatacaataaaatagacaactaaaaatagacagcactaatatgaaaaacaaaccgttattatttttactctcagtatgcggacttttagcaatatctgcacgtggagaaaatccacccgctaaagtgatattcgaacagtacatgaatcaagctcaaacttttgccgataactatccgcgtgaaaaagcatatctgcattttgataatacaagctattatgtgggcgacacgatatggttcaaagcatatgtcactcttgccgaaaaacaagttttcagttcaatcagccgtcctttgtatgtggaactggtagatcaggcagggcacgttactgataaacagatcattaaactatcacaaggagaaggcaacgggcagtttgtactcccccagtcaatgctatccggttattacgaagtacgtgcttacacccgctggatgcttgcattcagtgatccgcagtacttttcacgtactttccctgtctatcagctttctcatagcgaccagttggagcgtagtatcagcacctatgagttgagtccgtctatggagaaaaggccggaagaaacaagagagaagctgagtctgcgtttctttccggaaggaggacagttagtcgaagggataacttcgcaggttgctttcaaagcagaaagcaaaaatgaaggaaatattcaattatcaggcacactttataccaaagaagggcaagaaatcacgtcttttgaaactttacacgatggaatgggagcttttgagtatacgccttctgctctgccggcaatcgctaaagtaaactttcaaggaaaacagtatgaatttaccctccctaaagcactgccaagcgggtatattctgaaagtaggcaataatgcaggggctatttctgtgacggtatcatgtaatgcagcgaccccgcaggatacattagccgtttttataagccatcagggacgtccccatgcctatcagcttatccactgtcaggcaaataagcctcagcaatttacagtattgtcgcgcaagttaccggcaggagtcttacaaatcagtctgctcaatcgtgccggaaatactttatgcgaccgctttatctttgcttctccacgggctcctttacaaatctcgcccaaaggtttaaaagagatttacgctccttatgctcccatccgctgcgaactgcagttgaacaacgccataggagaaccgatacccggcaaattatcagtcagtatccgtgacgccgtccgctctgattatatggaatatgataacaatatcttcaccgaccttctacttacatcggacttgaaaggctacattcatcaacccggctactacttcacagagagttctctccggaaacagaaggaactggatatactgttaatggtacacggatggcgtaaatatgatatgacacaacagatcggtatcagcccattcaccccacttcagttgccagaaagccaactggtactttatggacaagtcaaatctacgattctcaaaaacaagctgaaggatatagctctcagcgtaatggtgaagagagatgcagagattattaccggtcagaccgttacggatgagaacggacatttcagcattccgctggaagatttcgagggatcaatggaagctgtgatccagactcgcaaagtgggaaaagaacgaaataaggacgcttctattctcatcgaccggcatttctcgcctgctacgcgtgcatacggttacagagagttgcacccggagtggagcaacattgcccactggcaacaggaagctgaaaaattcgactctttatatatggattccatccgtcgggtagacgggctttatcttttggacgaagttgaaatcaaaagtaagcggcgcagtcaaagtacgaatatggcgactaaaattaatgagcaaagtattgatgcctactatgatatacgccaggctgtcgatcagcttcgcgacaatggcaaagttgtcaccactatcccggaggtgatggaaaaattaaatccactcttttactgggaccgttccaatgataactgtacttaccgccagaaaccgatctgttatattatggataacaaaattctatcgtcaacagaagtaaacatgatgctgactgaaatagacggtttggcttctattatcatcagtaaaggcacaggaggagtagatgatgaaattatccagaataccaaaatgtctaattccaatgatgtagatgtatcggaactggacaaatatagtattttctacctcattccattgcccagacatgatgttctgaataaacacgagactgcggctcttggtacccggcagactgttatgcagggatatacaccggcattggagtattattctcctgcttatatagataaagaattatacatggataaagcagacaaaagacgaactctttactggaatccgactgtgcagacggatgaaaatggaaaggcagtgatcgaatgttacaataatcagtattccacgccattgattattcaagctgagacactgagtaatgacgggaagctagggagcgtgacgtattctacagttgcagaaacgaaatagtatgctttaggatatttgacaataaacggcacacaatcagtcctaaaataacttttcaaaataagagaagagggtgaattcaataacttgaacttcaccctcttcttgaatcattagattagcgattaatagaaactaccattcaattgcttgatcttcgtctggaatctgagtattgatatcacgtgataatgtcaatgtaccttttacatgatagcgaatgatggtaccttccactggtatataattgaaataataatcaacattattaattattacataacggtgttccagataaggcttcgcgtcatccattgatgaagaaatacgaaatgaaggagtcacgtccttgtttaattcaaatccaatctcttctgcattatcacaggaaatagtaaccgaaccattcgtctcaccattaaaagcaaatttgattttatactttctacggtctgtataatcctcatctactattcctgcatacgtaaaaatagtctgttcatctatcacataccctcttattgacgattttgtgatagattctgctgtttctatcggtttaccatctccatcatatcccgtcaccaccttgttggttattcctgtaccagaataatcgccagagtaatcattaaatgggaagattctcaatatcgccttagcatagtctttacgtggatgagctacgtagttgtaagacgcgtcgtctacaatctgcaatggaagtacccatttttctgacatatcaatgttgcgaaaatcaaatttaagatccagtaaacctttattttctcctgcttttatctgtagagattctggatatgaagcgtatgccaatccttctgctcccatatcctcataatatagttctgtacgtgtagcgtaacgagcgtaattcaaaatattcaatgtatcagcatcatgtgctacgtgtacagtgacattacttggattatcggtagaaccactaacaagtatcggtaactgataattggacctcccttctcctccttctgcataatttccttctgcatcatggcggctataaggtacatatatattcgtcactcccttactatccagttgtgaactgaaagaaatgtagtgctcatattgttcatcttcccattccgaattgcaggaagttcccaacattgtcattgcagccaaagctgccaaagtatatattttcttcatatataagtctttatgtttagaattaatcatacattgtccatcctgggttctgtgttaaacgtgaattacgtttcaactcactatgtttgataggccataaccatagcttttccgagaaagtagacgggagattgtaaacaggaattgccgaatggaattcgtctctcttagcttcaccaacaaagacattacaaccgtatatttgcagagattcttctactggcgcatctttccaacggcgaatgtcaaagtaacgttttccttcgcccattaactctatcatacgttcacgttttaatgctttacgcatatcatcaaccccactctgcagataaaattcgtctggatagtcaggcaacccggcacgaatacgtaccggatgaatacctctttccatttgttctttatcacggctgatagtgtaggttgtcgcctcattccaagaaggtatattgtatgttccagtcaactcattcaatgcttcagcataaagcagtagaatatccgcatagcgaattgctgtttcagctttcgcaacataattgcctggatagtcgtttggatgaacaaactttttgattcctatacctgtacgcaagtagaaaccgtcattacgataaccatcggaacttccaaagtagtaccaaacttgttgatttacatcggcaggtttgctttcagtctggctcaaataataccaggtacagccattataagcaacagaagcatagaatcgtggttcgcgttctacatattgcaaagaaacattcatcccagttttggcctgatcgttatctcctttcttcggatcatatttccaacctaattccggatatttattatccttcaagtcttgcaaatcagtaaatccggttctacgttcacgagtatctacaataccttgataattagctactccttgatacatagagttcatacccggctcattactaccattattcatataatatgcatccagcattttctgtgtcataccatgacagttccagccgccatcatctttgggcatctgatgaagtaccaacatatctatatttgttgccccgcgtgtaaatatcagttctttattgtttgcaggtaatatagtaccatcaaagatagtacgatatgatctgagcgggtcaatatttgtccatccttttggccagggttgattggaaaactcgccatcagccggtggagtaacagtcggacgttcagaaggtccattatcagatgtggatttatttacaatattcaactcataaacatctaaatcgatgacatcacggcaagcggcagcagcttttgcccatttttcttcactatattcggaagaaagcaaacgacgcccttcatcatctaccaattgctgcgcatattcatcattatttccattagcaaacggactagctgcaaaaatcagtgcataagcacgaactgccaatgcagctccacgagtaggtcggcctatagcataattatcagtacgacgatcatattgtaactctttagtagcctgtaccatttcgtcactgatatattgtgccacttcttcgtatgagctacgtggagtagctatttgatcataactttgagtataatccactccttcgtccggcataataggcactggaccataacgacgtaagagcaaccagtaatagtaagcacgaacaaaacgagcctgccccttataatctagtatttcccaatcagccatctcttgacaccggtcaacattatggataaatactgatgcttggaaaattcctttataacatgccccccatgccccaacattataagtattctcatcatattctcctaacttgaacatattatatgacaattcattctttgttgcatcgattgtcttatcgcggtcaccataatacatatcgtctgaaaaacaaaacgaattctcacttggtcctttagtcgtcacctcatagttttcattttttataaatgaaaaagcataagctaaccattcttccacatgatccttactttcgaaagttttctccagtgtcagacgatccttaaaatatttctccgaattcaggtaatcagagcaagaagaaattactcccatccctaatacggttaataataattaatattaacgtgtaagtaatttaatcaaaggccggatgatattaagggtattattcggccttatttttttaaggataatgtttattcataggctttcgattttaattaatgttttacataaatatggataattccatctgatttttctattcttgccgggacagtccgtattagtgtctgaagaacttcgtcaagatcttctttcaaatctagtttaccactgcaggtaatggtcttcaatggactgtctatcatgatctttttgccatagtaatcgctgagttttgtagcaatgtcttttagtttttctgtttggaagaggtaaaaaccatctttccaggcgatatatttttgtacgtctaccgattggatatggatgccttcctgttcattataacttaataagttattgggagaaagtgtcttactttcatttttgctggtttttacttttattttaccacttactaatacaacactttgcgtttgtttattttcataagcactgacgttgaatgtggtgcctaatacttgaatgtccatttggcttgttttcacgatgaatggccggttcgggtcatgagatacactgaggaaagcttccccctctatatatatttctcgtttgtgttgtttaaattccacaggataaacgattcttgagttagcgcttaaccaaatacatgtaccatcggtgaaagtgatagatgaacgtttaccggcaggtacgattaattgattataaatattagtcttttccttgtcatcagtttcttgaataatggtttgggagtttacattaatcttgccctgatgatcatattgtaattgactttcttttccatcaatatctatctgtttttttttcgaaagtacgagttggatattatcagtaggagtagcgttcggcctttttacagctgttatttccagttccgttttttcttgcataatgctgagttgtgattgaaaataccatgccgaacagagtataagagctaaactggcggcaactaatatactatgattaataaaaagaattttcttttttcgttgtttttctatattgttgagtctggaaatattcttccacactgtttctacttcgttttgcggtaagtgtgaaacaggaatgtgtcgaatatcatgcagaaaagaacgtgctatttttatttcttttgctaatgctttatctttttgctgcatcgtttcccaaaaagcgatactttctgggctgggatgctgctcagactccaaaaagtagaaatcattgagtagttgatctgcagagtagtgagtatatttgtttttaatgtccattttcaatgttgatttatcttaggacaatctcaattgacaaatctactcaactgctctttattttttttgagatttttattttttagtgtaaataggtcagttgatggagtattaacatccatattccagtgactccataggcttctcttattttttgtagagagcgttgcaaaaggttataagccgattggtaattgagccccattatctggcaaatatcatcgtaactcagttcttctataaagcggtaataaataacttcccgttgtctgggagtcaggattttcatcattcttttaatattattcatttcttcatgccgggcttcctgatcaatgaattcgtttttaacagtaagctgctcttctgtttggtataaactgaaagcatagtttttttgcaatcgttcttgattgaaagtattatagatgttattttttaaagcaatcattaaatatactttaggattttgaggtacagtaagtttctttttggctttatatatctttacgaatacgtcctgaatgcagtctttcactatttcagaatcaggagtgatttgtaagccataattatagagcacttggatgtaatgagtatatatccagctgtatgcctggtcatctccttctaaaaataacttccatttgatataactttcgtcttgagtgaacatagaattattacttaaatttgcctgtcgcattacacaatgaaagcaaagatagtattaaaaaataataataaaagatttatgtttaataattcttttctgaagaaattctttatatctcgaaggagacgttaaatatttaaggttctatgtgtatcattttatagtattccctctacaaaatactgtagagggatgttaagagtagctatttttcttgtttaaatttcgagttgtttcccttgaagcagaatttatttcaggaacagagaaactacacaataaatacatgcagctaggagtccactgacagggatagtaagtacccacgcagtcatgaggcttttagtcaccccccagcgaacagcggataaacgtttggttgctccgacaccaatgattgctccggtaattgtatgagtcgtactaacaggtattttcagcatttcggtgatataaagagtaaaagcacctgcggtttcggcaaccataccttccaatggagtaactttagtgattctggttcccatcgtttttacgattttccatcctccggacatcgttcccagtgagatagcagtaaaacaggagaacgctacccagtccggcagatcagaaatactgtttattcccattcccagacccatagagtgggcagctatcattgcggcggcgataatacccattaccttctgcgagtcattcagaccatgtcctacactgaacatggcggaagaaaccaactgtaatctcttgaaccacatttcagcggtatgcggatttgtacgtcggcagatatagagcacaagtagagtaaatccgaaagcgataatcataccgataaatggagccaggaagataaaagcggcaatcttaagaatgatattgagctgaatagcttcaaagccgtttgccatgatagcagctcctgcgaaaccacctataagcgtatgggaggaagaagacgggatacccttccaccaggtaatcagattccagaaaatagcggcaataatgcccgccaggataataggcagcgtgatgtattgttcaacaactgtctttgacacagtgtttgctatgccaaagccccctataatgtatttggctatgaagaacgcaacgaagttaaagaatgctgcccacaataccgcttgaaaaggagtcagtactttagtcgatacgatggtagcgatcgagtttgctgcgtcatgaaagccattgatataatcgaatatcagagctagtataatgatagtcactaataattccatgtgtcttgctctgcttttatgaatactttacgatcaggttttttaatattttccctacatgttctgctgcatcggttgtcttttccagttcatgcatgatttcttttattttaatcagttcgatacagtctttttcttcttcaaagagtttggtgataaaaagctcgtatacgtcatctgcctgattttctatatcgtgtaattgggtgcaatagtcgcgtaatggctttggatttttgcggaaagtctccagttcatccatggctttacctatattgatagcctcctcgtgaatcagacggctcagttctttgccactttcggaaatagggcgaggattatagattacaatacgcttggcgctactgttgattccgtcgataacatcatccatgcaggaagccaagtcgtgaatatcttcacggtcgaagggggtgataaatgtcgtacttaactcgtcaaagattaaatgagtcaatctgtcaccttcacgttccatgtctttaatttgtttgtagtaatctgctctttctgtgggcagatcatgttccatactttcaacaagtagaacggatgaggcagataaaacatctgataactgcttcagtagaggaaagaactttggttctttgggcgtaaatttactaaaaaaagaatttttcataaatatgagtacattaaattgtttttgagatgtttaatttgatggccgttgttattaataaacaaatgaataaagttttttattgcttcgatcctaacttcgctcgtaatatttctattattgcaggcaatattgaaataaatataatagcgataatcaagagtttaagattttcctgtacgaacggcagatcgccaaagaagtagcctgcatagcaaaataaaactacccatatagctccacctatcaaattgtagatcataaaataatagtaatgcatttttcccattccggctataaatggagcaaaagtgcggacgataggcacaaagcgggcgagaataatcgttttcccaccatattttttataaaattcatgcgttttatcaagataactttgtttgaatatcctggaattgggattatgaaaaagtttgcgtccgaaaaaatgtccgatcatgtagttgcaggagtcacctaatacggctgctgcaaataagattaaaacaagaatatggatatcgatcggcataccgggtaatgcggaaatggctcctgcaacgaaaagtaaagaatcaccaggaagaaagggagtgactacaagcccggtttcgcaaaatataatgatgaataggatagcatatgcccaagtatggtaatcctgcactatattaatcatgtattgatcaatgtggagaataaagtctaatataaattccattatatatcaagttattaatatgtaaaagtgaaatcgtatgcatattcccggcaatggaaaagactcttcttgctttcttgccttgaatataaagagataaaatgggcatgaagatacactcatctcatcccatagaaggaaaagagatatttaaataagtattcgtcctagtgtatagacgtaatatctatatgagaatttggtgagatttgtgtagtaggggagaccagtccatttttctttcggaaattgatattttaaggaacttagtatccgaattgtaacggaagaaacgttgaatcttagaattttggaaagagaagtggtacgggataaaagtgagtttcctaaaataccatcggcaatgttgcaatcatattttccatcatatttcccttcttggaaggagttgttttctttaccggattgtttgactacagctttggatcggtaactctgtgacttattatgggattgtatagtggtagtaccggcctctgtccggaactcctgtaattctttatcgggcactaaattgcatccccatatcagaaatataccaaataatatacagaaaatgtatttcgccataacagtcgcaaatgtagaaactatttttataagaaatacatattcgaaagtataattaacaattagatttgggctccggggaactggaatctaatggtaatatcttcttctttatttgtttgatatgagtttcatcggagtataactgattccgtttgtttgttgcctgtcgtttgttttttcaaatcccagagattcgtaaaacctgatagcgtatgtagatgagtttacagttatttcatttgccggacaatcacattgggaatagtcaaacagttgcttgcctatcccttttctatggaattcctttttgatgaaaaacaaagaaatgtgtttgccctcattcttggttcccataatacctattagtttattttcttcgaaagctccataaatgcagagttcattcatcaatttatcgttgaatataaaacttttgaaactctcaagaccttcgtcttcgaaatcatcctgaccacattgcaagtatacttctaatgctaaagttgtcgcctgctgaaattctgctttatctaatttgcgtatcataattaatcatttgttgagaatataatttttgtctgtcgggcaagatactgattttttttatttcagacaatagggtatttgcagattgaacgatcttatttatagaagcaggaattatttactttaaaactttattaagatgaaaaagtcagttatacttttggttggatggttattagcttttttatatatggatacaataacatatatgacgattaggtttatatttctcattattataataatcaacactttatataaagaattagttctgcaaagactttgcaaatttcgtacatcggtatgcaaactcaagaagtagcgattaagcctaatttaaaggtagtacttaggtcggatgctcaacagatcgatgaagttgttgttacagcaatgggtattaaaagatctgaaaaagcattaggttatgctgcaacttcagtgggtggagaaaaaattgcggaaagccgtacatctgatgtgatgtcaagcttggcaggtaaaattgcaggtgtacagatttccagcacttcatctgaccccggagcctctaattcggtcattatccgtggagttagctcactctccggtaccaaccaaccactatatgtcgtggatggagtacctttgaataactctaccgtatactctacagatggcttgaatagcggatatgattttggaaacggtgccaacgctatcaatccggatgatgtggcaaacatgactattttgaaaggtgctgcggccactgctttgtatggtagccgtgctgccaacggtgtagtcatgattactaccaaaagcggccggaaagaaaaaggagttggaatcgagtataacggtggagttcagtggtcaactgttctgcgtctgccggaatttcaaaatgaatttggtatgggatggaacggcaaccatacagaattggagaacggttcctggggacctcgtttcgatggttccatgcagttgtggggtaatgtgtacaacaactctcagaaactgaaaccttatgtggcaatgcctgataacatcaaagacttttttgatgcgggattcagatatagcaacagcctttcattcaatggagctacagataaaagtgattattatgtatcattctctcagatcagcgatgatggtatgatcccgacagatgctgacagctacgataaatatactttttctgcacgcggcagccataaggcaggagcgttgacattctcttcttcactgaattacgcttatcaaaagaataactttgctactacgggacaaggtttgtccatgctaaactctttatatcagacaccaagagatatcagcataataggactggaagaccagaatgatccgttcaacactccgggatattattataccccctacggagttatgaacccttattatattttgaataactatttgaatgaatatgaatctgaaagattctacggaaaatttcaattggattatgaattcctgaaatacttcaagtttacgtaccgtatgggcttggatactacaacaggacaaagtgacaaaggaaaaccgaatctgtacgctctttattatgaaggtactcctaatggagaaggtcagggctccagcagtcctttctctggtgaaaccggacaatattctgagcagataacccgtcgtcgcgagataaaccaggatattatggttaatttcaatatgccggttaacgattttaatatcaatgcactggtcggtttcaatggcaatgaacgtaaagtctcttatcaatattcagaagttaatgatttaacgattcctacatggtttaatctgaagaactccggcaaaactcctatagtagaacagcacatggaactcagacgtctgatgggtgttttcggacagtttgaaggttcatggaagaatatgctctatttaacggttactgcccgtaatgactggtcttctactcttccaaaagaaaatcgcagtttcttctatcctggtattaccggtagttttattttcagcgaattattgaatgacaatctgcaagatgtgataacttttggtaagatacgcgccagctggggtaagacaggtaacgatgctgatgtgtatatggttaatcctgtgtatgcacaatcttccaatagaatacctttcggttctctgactttccctctaggaggtgtcaacgcttactctgcaggaaatgtactcggaagtaatacattaagtccggaaatgaccacagaatctgaagtcggtttaaatatggctttcttcaaaaaccgcctctcttttgacgtatcttattataataggaataccgataagcagattttctctttggctatggaccctgcttcaggctatacagcacagaatatgaacctgggtaagattcgtaaccgtggtatagaactcctgatcagcggcactccgataagaacaaaagatttcagttgggaactgacatggaacttcacgaagaactggagtaaggtgatcagtttaccggaagaattgggtggcattacaacgatttatggtctcaatggaggtaccagtatgtacgctataacaggcatgcctgttggtgttttcaaggctcaggtagccgaacgtgatccgcaaggacgtattgtagtaaattcatcaacaggtcttccggttgaagccagcgaattcggaatctgcggagatatgaataacaaatatcaaatgggtgtttctactaacttgaaatataaaggtataagcttaggcattgattttgatatccgtcagggcggagtgatgtattcacgtactaaagatataaactattttaccggtaacgcgatacagactgcctacaatgaccgtaatcctttgattgttcctaactcagtaaataaaatagtgaatggagaaaacgttacttatgtagaaaatacaactcctattacaagctctaacatttataaatactggggcgacggtggctctgatatgggaagctgcttcctggtagacaaatcatacgtcaagcttcgttctgttgtattaggttgggacctgcccaaaagatggttggcaaaaactcctttccaggcagtaaaagtgtctgcatatggcaataacttatttgtctggactccatccagcaatacatttattgatcccgaaatgacttcatttggtaacgaccttgaaggtaactatggagaatacacggctaatcccagctcacgtcgtttcggtttcaacttaatggttaaattttaaacaggaataaaaatgaaaaaaatattattatatgcatcattagcaacaacagcattgtttgcaggttgcgacctgaacatcaatgacgacccgaactacccgatgaatgatcaggtgacggcggatttgatattcccctctatcagtgcttccattgcttcggcggtaggcggagaaatttataattacgctggctttttcgctcagtactatgaacagaaaccggagtcgaatcagtataacactctatgtgaatatacatttaccgaatcttcccagcaaatggattattcttatagaatcctgtttgcaggagctttggaagatgcaaagcaggtgctggaaaagaccacaaaccctgccgaccgattcgctactaccatactaagagcatatgcctttcagataatggtagataataccagtgactcaccttattcggaagctctgcaaggtaatgccaatgccacacctaagtgggatacgggtgaaacagtatataaaggtatattaggtgagatagatgcggcagaagctgctttggatggaagtggtatggatgtgccggatttgatattcaataaaaatatcgctcaatggaaaggttttgccaatgctcttcgcctccgtatgtatctgcgtttcattgatgccaacatagatgcggcttcgtatacagagaaagtgaagaccttagtacaaaacaacgaattctttaccggtgacgtgaaattggattgtttcttggatgaaacagacaaacggaatccatggtataatacgaatgcggtcggcttgaccggtaatcattgtgctgcctatccgttagtatcttatttaagcagcacgggagaccctcgaatcgcttatggtattagtaaaacagatgcggatggaaagtatgtcggtcaacttcccggaggaaaaacacatatgcaaagcattctgggtactgacaactggaaaaacaaaaacgtaagtgcgattgattactctatcggagccacaaaacctgtctatttctttactcaggctgaattacaattcctgatagctgaggtatatgctcgttttcacaatgatgatgcgaatgcaaagagtgcttatgaagcaggtgtaactgcagactttgccgttcgtggatttgcaggtcaagagaataccattttggaaggagcgtgtgcatggtctgctgcttctacacaggcagacaagttaaacttgatatatatgcagaaatgggtatctcttttctacatggatcatatggaagcatggagtgagattcgtcgtacagattgtccgaaactgtcttcttattcagcagcacagatacaggctagtgagtcagtatacactccgggagagttagttgctccatggactaatggtctggaagcgggtggactgatgaaacgtatgacttatccattaagcgcacgtcagcaaaatgtgaatactcctgcaggggtaccgggaagtactccggtttggtgggatatcaaatagtaaccaataacttagtaagttttacgtatgaaaaatataatatacagcatattagtatgtttgccgtttgtctttggagcttgcgacaaatcaacagatgacacttctaaagtcacctattttgttacgttggaaagagagggtgatgaaaagatcgttttagaaaaagggcaaccctttgtggagccgggatattatgcggaaatgaacggagaagatattactgaatctgttcagataaaaggtagtgttgatgtcaacactccgggaatctacaatttagtatatgcggcatacaacgaggacggttttgccaaaacatttacacgaacagtatatgtggcagataatactgcttctcctttgaaatccggaatttataccgtagccgaaggaagcaaacgtaccgccccttctgtggtagctttcagtggatatgagattgtgattttccagatggaaccggggattttttatatcagcgatttcttaggaggctggtatgaccagcgtgctggctatggaccggactatgcaatggttggcaaattcgaattgaatgatgataataccattactcctctggaaagttatgttgcaggttggggagattccatggatcaaatgactaatacattattggaccctgcgactgggactctgaaatggactgttgcttatgccggtcagctatcttttgacattatagtaaaacaataaaaatacgattatgaagaaatatatgatattacttttagcttcactggcttttacattcgtggcatgcgacaacgatacagaaccaggtggtactgctgttgaaaaaatggcaggagactggtgggtgacagtgaatgcatttattgacgggaaagaagtagaagatcctttcggagcaggacatctgcaaatgagtacttacaatacagccagcaacagtgaaactgaaatgtggttggatgatttaggaaacttctgggaatataaactgaaagtaaacgtgaattatgcagcgaggactttctcgacaacaggctttgtggataatgtaacatatgaatccaaagtgaaaataactgatggcaaggtactggaaaaagctgccacaactcctagtggtatgcctgctgacagtatcgtatatatggtacaattcgacgacgatgaagatggattaacttataaagtttcaggcttccgtcgaacaggtttccctgctgacgatttttaacagaagagtttaaatatagagagggctgttccaatgatcggagcagcctttttgcaatctaacctcaactaagacagatcaatatataagcagtctccaatatttacaatatttccttgcctttaaaagaaaaatgaatgggacaatgtttttaattagcaacatccattacctgattaattgtatacaaataaaagcgcctcttatagcatgataccatatcaacaataaatcactcaaatccttttaatatagtttgttatggaatccgattgatatgtcttaataaacatttctttcgtttttattctttcatctatattcaaattgagacattccatacatctaatataatcctttggcgtctcagcaatgagcataaaggaattaaataaaggaggaagaccttcaaaagcaatatcagttccaataacaggaatgccacatgccaaagcttctataaccttgactttaatacctgcccctgtaaacaatggggatatcaaagctttactctgagataaaatcttatatggatcatctacaaagccaagaatatctaaattcaaattcggaactatatttttcacatctttattaggaaatccacgtcctatgattttaatatgtactttttttctcaataatggacctacagtattaataaaccacaaagccccttccgcattttctttacgccgccaatcgccaaacattgtgaaataatcctcaactttatcgggacttttattaataatttgttcatcaatatagtctaaacaaagattagtttccttatgataaatctgttttattaggtcacaatctttttgtgaaaaagaaaaaatatgagcattaggcagattcaaggacatccgttccgagaaaatacatatcttctgcattaaatatgaagaagaacgaagcacacgttgtgcaattacatcatggcaaagtaatattttaggaatacgtttatcaatatatcgtccatacaagaacatattactatgattaaaaatcacaactttataatgattcattttaagcaaatccctaactcttcgaagtatcagccaattaaaacgtatagaaaaagtaggatgaacaaaaggaaagttgcaaatattttttaatttagtcattatcgagttacgaattgttagtttcgtatttacatttcctctttcgggcacataatcattttcccaatcatatttaaaataaatcaaatcaacatcataacatgaagctaaatcattcagcattatcatagtgtttttttcacctgctgctgccttattgggaacatatgctgtcaaaaacaaaattttctctttcatataactttaattcctacaataccacaattcttagcaaattttatatcactatcactatcacctatcataaggcacttagctttatcaatatctggataatctctcaatatttgaagaaacatacctattcccggtttacggttaatatcagaatccgtcaaagcggtacaataataaattctatctattctccctccatagttcttaacttcagaaatcattcgctcatgtatatgttttaaatcctcttcactcataatttccttccctactccacgctgattagtcactataaatatatatttaaaatgggtattccaagctttcaaaatttcaagtactccaggaagaaattcaaactcttcccattttttcacatagtcatctggacgaagtctgttaaccactccatcacgatctagcaacaatgtttcaaaaccagttacatcaatatcttgtagtctcattatagaaagaattatttagaaaaggagatctgaaaattccgcattggccttgtcgtaatcttcgggaataccaatatcaataaaatatccattttgcaccacaccataaagttttcctaataaacattggggttgaagaactcctgtctcaaaagaaaatctctgcggtagtctgtcgaatatcggttctaatgtattgataatatatataccaccattaatcaagcctttctcgcaatattttttctcatcaaatctcctaatctgattagtatcttcacatatctgtacatttccgtaacggtcaaagttttccattggctttaatgccagtgtgattgatgaaggatataaacaatgccattcatataattcattcaaatttacatcaaagaatgtatcgccattcaaaacaataatattaggtttactagttctctttaaggctagttttattcctccacctgtccctaatggttcgtcctccacggcatattcgaaagcaaaaggaaactcatctttacactcatcaatccaatcaataataacaccgcgtaaataacccaaagatagaattacttttgatacatcaaattttgtaagatatttcagtaaataccacaaaaaaggtttgtttgctattggcgccatacacttgggtacttcatttactacactacgcaaacgagtcccaaatccaccagctaatatgataacttccataaaattatttattatattcttccccgaaaatattctcttccacaatacagcaaataatatgtcctatcaatgtttgacattcctgtatacgaggggtttcagcactaggaactttaatgacaatatcaaaatcatccattttacaagacttcatacctgtaagagcaatcgtcgtaatccccttttctttacatataggcaaggcatctacaatatttttcgaattacctgaagtagaaataccaataaaaacatctcctgccacaccttgtgcctggagttggcgtgtaaatattttatcatatccataatcattaccaatagctgtaataacactggtatccgtagttaaagctattgaaggaattcccggacgatcaaaataaaacttactcacaaattcgccgactaaatgctgagcatcagctgcactccccccattacccgcaaacatcgttttatttcctcgacgataggcctcagtacatacgtcagccgctttagcaatagccgctatcacttcttcatttttagaaagttccgctttcactcgctcactctccgctacttgttttcttacaatatcaatactttccatacttatgctatatctatttctgaactttatctgttgaataaatcttccatccgtgtgcaccgtcatcaataaactgaaatggcataacaaaaccattcaaattatttaaagcccgtaccacttcttctttacgtgtcggctcaaccacaaacatgataaatcctcccccacctgctccactaaccttaccggccatagcaccggcaccagtggctacatcaaaagcttcttgaatcatcggattagtaatggcgccagccatcttcttcttattttcccatccttcacccaaaatacgagcaaactccccaacatcccccttcaacaaggctaatttagtatcaatagcactctgtttaatcttatgcatcgcctctatagcggtttgattaccttcgctcgtatttttcttctgctcattaataatagcagcagaagaacgagaacgacctgtaaaatatagaaccatacttgactctaattcatccacaatccaacgtttcatttttagcggattaacaatcaccaaatcattttgcaagaattccatataattgaatcccccaaaagctgctgcatattgatcttgcttaccaccactcaatcccaaatccttacgttcaatttcataagctagacgcgacgtctcgtaatctcctaaaggaagtgacaaccactcaataaaagcctttaatatacaaacaaccatagtagaggatgttcctaatcctgatccagcaggcgcatcattataagttgttattttgaatgacttaggctcaagcctataatcacgaataatacggttatacacaccttttatgagacttgcttctccatcaatctctaattgagacatagaaaggtaacttttgcaacattgtgcatcataagcattaatctcaatcctaccgctgttggtctcttcaatagtacaataagcatataaattaattgttgcattgagaatcaaccctccataaatatcactataaggtgatacatcacttccaccaccagccaatcccagacgtaatggcgctttacttcttacaatcattttattgaaatatataaattattcatatagtcaaaaatatagaacatcctttactcttttagctagctgaatgaaacgatatgtccaattaatgataaatgcatcattgaaggaaataatattttttccaaccgccttatctaataagaggcgtatttgagattttgagattgcttgagaataatgtaccactaaacgaaaaaaagcatactttgtaaatcggtagacagatgatttatgaaagaactcatttatccaatgagtaaactcaatatcagcagtaagcttccggagcaccattttattatccatattaggtgttatattttttttgctcttacgccaatatacataatctccagaaatagttttaatacctttatcagctcctattttcacccatgtagctatatcacttccccatgctaaatcaaagtgctgaaaaccacctgtacaattataaatatcccttagaaaaatatactctactacaaaactatctaaccgagccgacgctttccgacgataaaaagtctcactatctatcaccgatggataaacagttggaattctcactatctgattttcgcaatcaacaatctttacatcaaaatgataaatgtcaaaagctccattatctattgctattgtattaaaaaaatattctacacaacgaggccccataatatcatcatcagaaaacagccacagccaaggctcattctgtgtcagttgtatacaacggttccattgtgcaacgagatcatgcccaccaaaattcacttcaaatcttctataaacaatatccaattgcttcgaatattgttctataagactcttaaaatcatctctactacaatcctcaccaatataaacagtgaaatctttacatgtctgttgcgctaaagagaataatacagtctcaaagaagtctaccttataggcaggtattacaattgctaattttttcattaatcaactttatagaaaatgaagatatgtccctcccaaagtataccgcaaatcaatagaacgttgcgccaaaacttttgctggtattcctccacatatagtaaaaggcggaatatccttagtaactacggcaccagctgctatcactgctccctccccaatagtaacactatgcaaaattgttacattagggccaatccatacacggttctttatataaataggaccacgattcgttttcatagatcgaaagtatggatcattataatcatgaccacctgtccaaagagaaacattagaagcaatattaacgttttcaccgatatagattcctccacgcctcgcatccagaatactattatctccaacgacagaaccttttcctatcatcaacatccatggtgcacgaatttcacttccataatataatactgaattcttttccatttttaccaagaaaatatacttgtaaaagaaatcacgtatatgatgtgaaggaatatccgaaattattttgatcatccaacgaaaataaccatccacaatattgatcaatcctcttttatctattcgtttgaacaattttttagaacaagaagaagaagtaatgccagaatccctaatttcactcacctcaccttcaggattagccatgtttttgcgacgatgcagccaacaataagccattagtaaaggagaagtaaatagcagtaaccaatacttaataaatacaactattagtataaacagaacaaccgataaattcataatctcattatcgtttcaacatttcattataaatattcaggcgccgctgtacagaagcttccggtgaatacatctccattagtttctcatgagcagcttttgtcagattatgttgtaaaaccttatctgttgctatttttaaaacaccagtagcaaaagcttgaggctcatcagctatgatacactcttttccatttataaaatcaagtccttctacacctactgtggtagtaacgaaaggcgaatagaaattgaccgattctaatattttcatacgaataccgctacctattaaaataggtattaccataatacattcagatataaccatagccaagttatctacaaagcccgttccggcggaaacacccgccatacgggcaatgtctttgatggtatagttctggtcctccatagtgctaaaacttaaatattataaataatcgctgcaaatatacgaattattttgttactccaagtaaattttctatttttgtgttcgataacggttaataaaactaaaacaaagatttacacctattagctttaaaatcaatactatataggtataaatgcagaaagtaataattttatatactaaaaacacagtaacaatgaagaacttcatggatgaaaacttcttgctgcagacagaaactgcacaaaagttgtatcacgagcatgcggctaaaatgccgattattgactaccactgtcatctaatcccccaaatggtagctgacgactacaagtttaaatcactgactgaaatctggttgggtggcgaccattacaaatggcgtgcaatgcgtacaaatggcgtagacgaacgctattgtacaggaaaagataccacagactgggaaaagttcgaaaaatgggctgaaaccgttccttataccttccgcaacccgttgtatcattggacacacctggaattgaagactgctttcggcatcgacaagattttaagccccaagactgcacgcgagatttacgacgagtgtaacgagaagttggctcagccagaatactcagctcgcggaatgatgcgtcgttaccacgtggaagtagtatgtactacggacgatccgattgattctctggaatatcatatccagacacgcgaaagcggttttgaaatcaaaatgttgcctacctggcgcccggacaaggcaatggcagtagaagttcctgccgacttccgcgcttatgtagaaaaactgtctgcagtaagcggcgtgacaatctccaatttcgacgatatgattgcggctctccgcaaacgtcatgacttcttcgccgaacagggctgccgcttgtccgaccacggtatcgaagagttctatgcagaagattacaccgacgcagaaatcaaagctatatttaataaggtatatggcggagctgaattgactaaagaagaaattctgaaattcaagtctgctatgttggtaatcttcggagaaatggactgggaaaaaggatggactcagcagttccactacggtgctatccgtaacaacaatacgaagatgttcaaattgttaggacccgatacaggcttcgactctatcggcgaatttacaacagccaaggcaatgtctaaattcctcgaccgcctgaacgttaacggcaagttgaccaagacaatcctttataacctgaatccttgcgccaatgaagtgattgccactatgctgggcaacttccaggatggctcgatagccggcaagattcagttcggttccggatggtggttcctcgaccagaaagatggtatggaaaaacaaatgaacgcgttgtcagtacttggacttttgagccgtttcgtaggtatgctgacagactcccgttcattcctttcctatccacgccacgaatacttccgccgtacattatgtaatttggtaggacgtgatgtggagaacggagaaattccggtatctgaaatggatcgcgtaaatcagatgatcgaagacatcagctacaacaatgccaagaacttcttcaaattctaaaacaagaattactaaatagtaataccgctgtcggggcacgatgctccacagcggtatttttttttaaaactaacgttcctctccttgtagtttcatatacgattctattgtcacttgtcaccttttatagttaaagagttagtaatcaataaaatagtggtgacaataagcggtgataataaggtgataatagaatttatatgaattcatttatcaccttctattatcacccatatttcctactacactgattaccaacatttaaacagaaactaacatctttttctctttatcacagagaactgtattttcgacccgagaattgtattttcaccccctttttgccttctataattcctattaatccattatttctccctccagtcaacaacaaaattttatttgctaaagcattaaacgatgcttctttggcctcctaagagattttagatggcatgtataatagttaaagccggtatacctaatacatcaacaagccttgattaatacattttgcaggatatatgctctcgttttacgtacgtgaaacattcagactacgcacgtgatcccatcagcccacgtacatgaaccgatgggatcacgtacctgaaacttgttcttattgctttcaaaagacattaacttagcatacaaaagggattaatcaacgaagcatagactattaaaccaggcaggtctgattaaatcggcaagcatctttcgggctaaggagcaacaagtcccgaagagtaggctcaaattgagttgaagagtagtcctcacaagatttacaactgatcccttacaaggcagttcatataaacaaaaaaagaagtaactaagttacttcttcattctttgtacaccctcagggattcgaaccctggacccactgattaagagtcagttgctctaccaactgagctaagagtgcaacatttttttatattgcaactttggatttgtacaccctcagggattcgaaccctggacccactgattaagagtcagttgctctaccaactgagctaagagtgcttatttcctcgtttgcggttgcaaaagtaggtcttttatttcatttgaccaaacaataatgcagcttttttactatctttttttcgttattattcgaacacataaagctcagaaggcgtatttcgctttaaagcaagtagttgcacatctttacctacaattacacctttgttctttaatttccattctaccgttttatatgccagctccggatgattattgtctttgctcagatgacacaaccagatataacgcaggtgctcggtgatattttctgccaggaattcagcagtagcagaattgctcatgtgtccggtcctgctcatgatccgttccttcagatattggggataaggtcccattttaagcatttcttcgtcatagttcgcttccagaatcagatagtttgccttgctgatataatctgccgccgtcggagtgatttcccctaagtcggttaagaaagaaaagactttgccgtctatttctatacaatatcctacattatccgtcccgtcatgaggaacttcaaaagattcgatacggaaatcttcgagcatcataggcacttgcttttcaagataacgaaccgatgtgctgagcttttccgtcatacaataactacgattaatcccctcatgaatacgagccgtggtgtaaacaggtatattcatcttttcccccaaatgccctacagccttgatgtgatccgcatgatcgtgcgttacaaatacggcacgtatactttccatcagaatattgaaatctttcagtgttttcttgatggtacggatgccgataccggcatctatcagtattccataggtatcagtacccagataatagcagttcccactgctgccactcgccaggcttataaatcttactttcatgttttatctttctttattaaaatgcaaaatgccgtcaacttttacagcaaagtgacggcaaatatacataaaaaagaagataattaccgagaagatttcttctttttgtcgatggattcggtgatttttgcgaataatagcaaagctatagcggcaatcagcccgatagcagcgaaataataccagatataatgcgcattcgcactggcggcctcccatgccgcacgagtttcaaacaaggcagggtccggacaatattttgtcaacagaataccagccagcccgaaaccgaatatagaagaaaggaatgagtgcagatgactgaatcctaaatacataccttcctctcccttaggagcctgcagagagaaatactccagataccgcggcgaaatgaaacattcggcaagcgcctgtacaacaataccagccaccatcatcagagtaatattgctcattcctgagataatatcatttcccaatatgtttccacaagccatcagcaatgcagaaacaggaattaggaacatacccacattcatcgaagtaatcgcactgcgctttgccatcaaacgagtgataaagctgacacaacataccaccacaaaaggattaacgttcgcgatccatcccggtttggccgtttcgcctgcgagacggatgacgtacttaggcatagtggcataaagttgctgttgtaccatccagaagcctgttacgattaaaatgagaatcaataaacgccagttagtcataatccgcataaagccctgccctatctcacgcagactttttccttcacctgccgtatgagtcgatttatatagcaggatcactgccagcaaggcaatcaccgtcatcgccccggagaaatagttaatgtaaatataagcttgttcgccgatcacatttctcaaagggtcgataattgtcttacccgtaaaagcaccgacattgaccatcatataaaaaatagaataaccacgggcgcgggtcgcttccgttgtctccttagccacagatgcggaaataatagacttgataaaagaacctcctatcataaggataaacaggataggaacgataatccaccgggaagaactgtccggcaaaccattaaaccgggtagtcgcaccgtaactcaccaaccctgccgcttcgagcaatgtagggaatacgcccagccccaaataaccgatagataataaagaaaaggcaataatcatcgacttccggaaacctatcttatctgcataagcacccgaaaatataggaagcagatataatcctccggagaaaaggccggaaatcatacttgcttcgaaatcattaaaacctaaaatactggataaataaatagtgagaacgataaaaacagcataatatgccatacgttcaaacagttcgactgtgttactcacccaaaaggctcttgtaaaacctttggcggcacgctgaggggaattgttcatgtaatctctgtttttttattaaaatgttaattcagcgcaaatatacgtttttttagcttacagtccgtatctttgtcctaaattacgtattctaaatatatcataatgactatagctgttgattttgacggaacgattgtagagcatcgttatccacgtattggtgaagaaattccatttgcagttgaaacgctgaaattgttacaacaagaaaagcaccgtttaatcttgtggagtgtacgcgagggagaacttctggacgaagccatagaatggtgcagagccagaggactggagttttatgcagccaataaagactatccggaagaagaaagagatcatcagggcttttcccgaaaactgaaagccgatctgtttatagacgaccggaatgtcggcggtattcccgactggggaattatctatgaaatgataaaagagaaaaagacatttgccgatatatacagccagcaaagagaagaaaataccagtcagaagaaaaaaagaaaatggttgccgttttaatctccgacgcgaaagatcagacttacatccattaataaaaatgcataatgcactccgggcacatcgcttcagagtgcattatgcattttctgaggagatctgaaacttacattactccttttgaccttcccacttttctctatattcccacagttgctcaatggtaggatgaaaagtcggattttcccagtttttggaaatcatcgaaattaaagactccagataaagtttaccatcaatgattgaagtacacgcattaacctgatacttttctgtcgggtaattctttgtttcaagcatctttttcgcccagcccaacagctcctggaccgattcttcatcataagtatgttgtgccatatttttatattttcctacaaagataaagataaaaacgagaatatgcagacccggacaagcacttttagtatttcaccttatataatatagatttcccgagagtgaaaatatataatagagcaataatactcatttcggtatttatcatatgcgaataaacgaattattctgtttgctcaaatagaattacgtacaaattagctgcattatagtataaccaacaaaaaagcaacatgatactttgtcatacaaaacggtctatgagagaaaggtaaaaatagtcatgcaaatttaccaatatactaatccaatgaatacgatactgccttctcccgatttacccacaatgaaaaacatagacactgtatactaaaaccgtatttgagtttctaataaattctttcatcgtttattagaaacggttcccaagtttattaaaaacgccgatacgcctttcaaatctctttttcttgaatttatgcaacaaaaaaggctgcaaactccgtaaaagtttgcagccttttgctcatttccgggctacttatgccctaatcctcataaggatctcctagatgttttgttatgatcttatactgttttgatgtcaaaaaccggtgattgtacggcaagtaacctgtcggtataagttctttgaccaacgggttacaacctttaatccatcggctgagacaatgcaccgcatttttactcgttgtacatccggggaagtacatcgcagccagtgcagcaaaagataagattcctctcattcgtttctaagttttgatttgagttttattgttgttattacgactacaaatatacaacataaaaaagcctttgtcaagtcctcaagaccttcgagcgttaataacaaattaaaaaactggagtactggcacataagcaaggattgcatcgtcaatgactaacaagtttgttactaacaactttgttagtaacaaacttgttagttaataaaaaggctgagattcctcaattcagacccattgtgtgcgataacagtgaaaatccgtgaaagaaatcaaaagagacgcaaatacaagaatattatttggaaggaatagcaagaagacttacatttgtcatgtgatttttttcatagtattagatttaaggttaacaaaggttggagcaaggcgttgctcctttttttatgccccaacctttctttattttacctcagagatttattactgtcattccagtactgtcattgactattttttcggctttccacagatataaaccttgcattggtaaggcgccaagtccaccattatgttattcgcagcattttccatagaacggctgtcaaggctatacacctgctccaaagacaggtcttccaccgtttttgaatttaattctatagtacgtggagtatccgcccggttaaaacaagctaccgctttgcgaccgtcagccaacggctttacccaaatatcataatgatctgcacggatgctgcgctccgcctgcttgcccaacacatcctggttgatagcaatcaggtccctatccaacagaacctgcaatgtactgtcattcatacttcgcacgtcatttccgcaaagtaatggagaagccatcatacaccataatgcaaaatgagacttatactgttcgtgggtgcaaccttccgattcatatccgatactcatactcttaccaccgataccaactaccagcatatccggatcattccaaccggaaggaccgccatattcactcaaaggagcattgatttcaagaatattcaggataccacgaagcccgcccaacttgttggcttcccggttccagacatcgcctatatctcccgaaacgcgccacaaatgtccgcctacctgttttgcccatttccaaggttcgcgctgtccccactcacaaatggagaacacgatggaacgtcccgtaccacgcaacgcctttcccatctttgcatagcgctccatagcctccacccggtcgacaggagcattgcaataatcatacttcaacaaatcgacaccccacgaagcgaaatctttcgcatccacttcttcgtagccgtaactgccgcatacaccgccacaagtcttatcggttgcatccgaataaattccgagtttgaaaccgcgctcgtgcagataatctgccacatactttattccacgcgggaacttatctttattaatctgcaaatgtccgtcagctccccgttcgggcaactgccagaagtcgtcgatgttaatataggaatagcctaaatcccgcattccgttggctaccagcgcatccgcagtttgcaaaaccaactcttcggtgagatgtcgcccgaaagtattccaactgttccaacccatgggaggagtcagcaacaggtcatcaccaatgcggatcacgagcttttccgtactggtccccaatgcgttcttagctttaagagtgacggtatattcacctttagaagctactgatcctgtgataatccctgttttcgaatccagtttcaatcctttcggaagtttctccgcactccattccatcggccgctgaccggtagtaggaatataaaagaggaaaggactggcaggataattgccaatcgcccggggagagttaatacatggttttccttcaaaaaccttttgagaagcatccggtagagagatatttccggcaacagatacgcttgctacaaaaagagcaagaatagacaaaattacgatacaacgtgtttgattcatagttgtttgttttttattacgccactaagataagggaaaagaagcaggatgaatggtgataaacattttttttatacctttgccgcccgcaaactaaaaaaagaaatatgatattccacagaatctttcgtttcacctattttcttattttctgtatatggggactgcaaagctgcaccaaagacgacttaatagaaacgccggcagacacagacagcgaaacaacagagaacccgtatggaataatccggatagcagagaaagacctgactccggatgttttcaaattaatgcttcaggatgatgagcctgccacgattctattcaataacacccagcggggattcagagtaaaccagcccctgcaagtcagcatcaccgagcagcaagagttatttatccgtttctattcgccccgtcctgtcaaggaggtgactgtgtgggcaaccatcagcggatatgaagaagcattccaactggcaaagttcgatgtgctcccagctttcactgaatttcataaggaactgccgatgctgacgcaaagcaagcgttacatcacccgttcaggaaaagaaatccagattatggcaaatccacacctgtccgcagccgacttcaaactggaaatagaatgtaatgacaaatactatcaaaaactgctttccaccaagtccaaatacaacgtacgtttctccgcctatagtcagaccggttcatgggcctatccactttatccggctcacgcccgggaagcggtagcaatgatgctgaactacggctatatgttctcgtcaaaggaatttgccgaagaactggaaaaatacagaggcaaactgcatagtgacgccaacaaaactgttattgacatcgatatgctcctcaaaaaagtaatcaaccactccggcttcgttatcgggaaagtgacaaccgtagacggactgggaggcggagaaacttatggactcaacgaatggtgctttctggaacactacgcagacgacggagcgcacaccagcgccacgtttcacgagttgggtcattgcctcggctacgggcacagcggaaacatgacttacgaacaaacgggaaccggatggattaccctctgcgccaccgtatacaacaaactatgcatcgaaaagaaacttccggtgtactcacgaagattcatgcacacccgccgctatggcaaactttatggcagctcaaaatacaacgcttcccgatacatcattgaagaccctgaactggatgcaatcgacggtggactatcgccgatattgaaagaagaggatgaggatactgcgcaaggaacaccactctcctgcatcatcacctacaaagatattccccaagccacggaatcgacttttgcgcccaaggatgtctgtgtatatggcaaccgaatctacatcgtgaacaatgccagcggaaatttcagtctggagattctggaagagcagaacggcaaactgacgcacataaaaagcctgaaagagtggacggaaggaggggcaacaaagggatttgccgcaacaccgaacggcgtgaccgtagcccacggtaagatttacgttacaaacgaacaaagccggactgatatttttgatgaaaagacttttgaactggtggcaaccatcggcacaggctcttggggagaaggaagcaaccaaacggttcatgctttcgatgtactggtacaccggggatgcgtgtttatccgagataagaaacgggtatgtgtatttatcgaagacgatattgtccccggaaaaagcttcaaaaatgtgcccaattattgccggacatcgaatatgggagaggcaatgggtacttacgggcagacaatcggcaacgacgggttactttataccacccaccagggaaataagaagatttatgtattcgaccttcaggcaatgcgcgaacaggtggaatggaaagcccaacgggtcattaatctgacctcttattcgccgtacgacattgcatttatcggcaaacgaatgttcgtctcctttgctacaggcaagaatcagcctatcgccctggccgaagtcaatccggagacagggactgtgattaaggattacacaactgtcgaaggacacaccttcagtaacgtggaaaagatgtcaatggcacggcagacattgttcatagtagaccggaatgcacatacagtaacgggaatccctgtagaaaagttgaattaaaaaaaaagaagacatgagaaaagaaaaattatataccggatgtctgttactaatggcattaatcacaggtagttgctcggaagaagaaaacccggaagtccgcccggctacaaaacccgcagagccatatacaagctattattactattcatacgaagcggcacgacagttatccgccacagacttcgccttggctgaaggtcaattcacccccggacctacttacataaaaggagatactctttttgtagccaatattcaaagcggagcttttagtctggaactttatgaccggaacaagaaccgacatctggcttcgctcaaaagctggaaatataaagaggcagaacagaagtttccggataagattgaagcgatcggaatatccggtaaccggctgtaccttgcaaacataagttcccgaatagatgtattcgatgtacggacgctggagttcatcacacgcatcggcacaggtaactggggagacggaatcaatcagatggtacactctcacgctatggctatcacaccggacggaaatatcatgattcgtaccaaaaagaatctgttagtctaccgggaagctgacgtaactttggagaattatcagaaagttcctttctattgccgcagtaaaggagatggaatggatgtgaataacggtttccattctcatcagatggtgcaggattccaccggtatcgtttatcttgctgatttcgggcaatacggcaatcagaaaattcaagccatcgacaccacactgatagaaaaaggagatcagaagatactgattgacacagaaaaaacgctccctctgagcttcaatccctgcggcatcgcgttgcatgaaaatcgaatgattctatctgcccaaaacgggtctctatttatctatgaccgaaccaaagggaactgggaaaacagttttaagtccgtcaaaggatatacttttaagaaacccgagaagctgctggtagaccaaaacactctttgggtctcggatgtaaacgcccaaaagctggtagaagtaaaaatctataagaatgaaatacgggaatattaattaaaaatccatcctcgccacaaagatagttgtagcgaggatgatttcgttaaaaggggagttttggcacatttacatttgcagtattaaatatcacaacaaaatataagtgtatatttgaaaagtagagttgcagtgaactaactttgacactagtcttaaatgactataggctgaatcagactgcaactctctcatactactattgatattttttcgcgattgttgggcaactagcatatatcaaaaaatcagcatttacatccaattcagcacttattaatatattatactctacttatatatctacatgattatattttcatcagttctgtttattttcaacattagccatctaaactttccaaagagcgaaatagaaaacagagaaggtcaaaagtattaaataaagacagttttatcggtataatgacactatagcaatggtttacttacatcatacctaccttttagtgacaccatctgcatcttttggttacttcatccgcatctttttcacaaacaatacggtgtttttcaccgaatcatacggtcatttcatgcaaatcaaccgtatatttgcgataattcaaccacctttccaagctaacagaagattattaaaaaacaggcaggaaagcaaatcggatctttctacaaacaaatgacagaagaaagacttatcaccgaacattatgataaaagcaatcatctattgatataataacaactgccctgtaatctgatatcagactacaaggcagttgctaaaacgttatactaattcccttctatctgtcagaatgggaaaatcagaggcagcaccaatatcatcacaattcccatgataatctgcaacggtaatcctacttttatataatccataaaagtatattgtccggcaggcatcaccagcgcattaggcggtgtagagaacggagaagcgaaacacatacttgcacccaccgtcacggcaaacaggaaaggaaccggactaactccgatctgcatagcactttgcaaagcaatcggtgcaagcaagacagcagtagcggtattactgataaacatagtcatcaatgatgtcgtaaaataaataccagccatcaatgctatcggtccgtaagatccaagcccacttaccaaagtattggagatgtactccgaagcgcctgttttctctaatgccaaagacataggaagcatagccgcaatcaatacaatactttcccagttgattgttttgtaagctgcttccacattacggaaacatcccgtcaaaaccatcaggatacctgctatcataacggccgtaacaggtgcaaccggaataaaatcgaataccatcattgctaccatcaataccatgatagcagcagcaacaggtgctttatagtccaaagttactttagccgcttctgccaaaggctgtcccaacactacccaatccgaatcttccttactaagccgggcaatattactccaagttccctgcactaaaagcacatcaccactatgaatccgctcatttcccaaatcctgcaacagatattcctttttacgacggatacctaatacattcacattaaacttatcacggaatccggactctttaatggtctgattgactagattggaagcaggcatcaatacaatttcggcaataccgatatcataaaaatcaagcgaattagtagtgcttttcgtctcttccgtagcatgatcatccaatatatccagcagataatcttcggcaaattgctgcactttatcaaattctcccgtcacatacagaatatcttccgcttccagcatagtatccggttcggcaagtttctgagtaatagtcttcagaaaacggtgctgcgaagcatctccacgacggacttccataatattaagtccatatttacgacgaatatccagatcgaggatggtctttcccaaaaggcgggagtctttaatcacctgcatacggaacagattactggaaagaccatattcattcaccaactgtttcagcgacttacccgaacggctgttatcatctttctgcccttttttagaaagaaaccacttactaagcggcatcagaaccagcgtaccgacagccacactcaccaaacctacaggcaggaaagtaaagaaagaaagcggttcgaagcctgcggaagtcaatgtgttttgtatgacaaggttgggcggtgtaccaatcagcgtcatcatacctcccatactactggcaaaggccaacggcatcagcaaccgactcggattcattttggcgctcatcgccagactgaccacaatgggaagcatcagtgccaccgttccggtattactgacaaacgcaccgatagcggaagtgaccaacataacaaggaagaacaggcgaatttcactgtttccagcaagtttaaggatacgcgaacttatcatttttgccagtcctgtctgaaaaatagctccgcccacgacaaacaatccgatcatcataatgactaccgaattggagaaaccggaaagggcttcgtcgggtgttaatatctgaaagataagcaaagctactaacgcacatagtgccacaagatccgaacgtatcttaccgtttacaaaaaagatagccgaaagaacgagaatgataatggttatcaacataagctaaaaataaaatgattgttttatcctgaatgtatcaaagatttattttggaggagcaaaattaaaaaatactttgccgttataaaaacaaattagaattgtttttggttcatgggacatcatttaatattttaatacattcttactctttacgaaaatacgttccatcaaaaacattttaaaaccgaaccggaaatagaaggcaccaaagttctactaatcagtaaaggtattcttttcagaagagttttataaggctgataaacaatatatttcagaaatttcctttgtgaattacaaaaaatgcatatatttaccacagatttagtacaaacataaattatggcaaacaatatactatccgttatatggattacagaccagcattggagttattattatttactaataggctttttactcctgatcatctgctttttattatacagactacgacaacttaaaaagaatataggaaaagaacaggattactatcattctttattcgatatactcgataacctccctttccctattatggtaaaagatatccagaatagtttccgatactattactggaacaaagaatccgaactgcaatccggcattaagcgggaagaagcaataggatgcacagactacgaaatctatggagaagaacggggcagaaaataccgtgatgtggatgaatcacttgtgcaggcagacaagatataccgggcagaagaaagctacagcacagtggacggagcagtacatgatacaattgccgtaaaatcgattatcaaatggaaggaaaagaaaaaatggctgttagtgacccgatgggacatcacccggctaaagacttacgaacgagaactgattgccgccaaagaagaactggaaaaagcgctgaacaaacaaaagctagctttgaagagcgtcaacttcgggctcatttatatcgacaaaaactatctggtacaatgggaagaaacgacgcaaattgccagcctcgtgaaaggaaggcattatacaccgggacaaatctgctacaaaacaagtgcactccgggatactccatgcgaacaatgcgcctttcagaaagcgattgaacaaggaaaaatcatacgccatactatccagatagatcaggtagactttgaagtgacagctactccggtttatgataatgaaggaatagaaatcatcggcggtctgttgcgcttcgaagacatcaccgaaaaggtgaaaatggacaagatgctacaggaagcaaaagaaaaagcagaagaatcaaaccgtctgaaatcagctttccttgccaacatgagtcacgagatacgtactccgttgaatgcgattattggattctctgacatgatttgccaaacgggtgaagaggaagagaaacaggaatacatgaagatagtgtccagtaacaatgagttgttactgcaattgatagatgatattctcgatctttccaaaatcgaagccggaacgatggaatttagcctcgcccctaccgatatcaatgatctgatggaaggtatttgcaggcaaatgcaagagaaaaacacttctcccgacgtggcgatcaccttcacggagaaagcggaagaatgtattctcaacacagaccgcgtacgtctttcgcaagtaatcatcaacttcacaaacaatgcgatgaagttcactccgaaaggttccatccaaatgggatatcggattgacgaagcaaaagatgaaatctacttctatgtaaaagacacgggcattgggattccggaggataaaataaacgaggtattcgaacgtttcgtcaagctgaatacattcgcaaaaggtacgggactcggtctggctatctgccgggtgatcgtagagcgcttaggcggcactatcggagcagattctaaagaaggagaaggttcgtgcttttggctcagacttccgataacccaaaaatcaaataattaactgtaaatggctgtacacactaattcatacttgtacagttttactcctttctgtttaggaatgaactaaacagtagtacacaatagtaactccattctcctccttcgggaaggaggagaatgaaagatagaaccgactattatttagttcaaaacagtgtcaaaagaagcgatcagagggcagcctccaatattttacgggcaacggctcctgtcacattctcattttctccatacttggcaccacgttcattaaaccggcgttcaatttccaaaacggtttcttcaccgatattttcttcatgcagacgagtagtcaagcccaatgaacggaaaaactcttcagtacgatcaattgcttcatcaatgcgttcttctttcgttccggaagtaattccccatactctttcaccgtattgcaccaacttgtctcctttcgcttcccgaaggacacgtaaagttgccgggagaataatcaccagcgtatgcccatgtgtcagtccatgcaatgcagtgatttcatgaccgatcatgtgagtcgcccagtcctgagacactcccattgcaatgaagccattcaatgccattgttgcagaaagcatgaaatctgccataagctgataatcatgctggttctcacgaatctttggagctatttctaccagagtttgcaggataccttccgcccaacggtccatcacacggctttgtccggcaactgtcatgtattgttccatcacatgaacgaatgtatccgccaatccgcacgccacctgatgaggaggtagagtaaaggttacttccggatcaagaatagagaacaatgggaaattggaataaaaaggatatttttccttagtttcgtgacgggagatgacagctccgttattcatttccgaacctgtggcaggaagtgtcaatacggtagaaagcggcacagtcttggtaaccggacgtccggcaagtaccaaatcccatgcatcaccgtcatataacaaacctgcggaaatcaatttcgtaccatcaatcacagaaccaccgcctacagccaatagataatcgactttctgctccttgcccaaagcaatcgccttgcgaagcgtttcgatggccggattaggctcgatgccccaaaactctattgtaaaatggtctttaagcgcttcttttacctgatcatacacaccattctttttcacgctgcctccgccaaaagttatcatgatacgtttgtcggatggtatttctttgctcaaccgggcaatcattccatgccccataatcagctttacgggattctgaaagataaaattttccatatctgtctattgttgttattttggttattagttactaaccttgcaaatatacgccaattatctgaaacctgtcgggatcaggcaatgaattgttgcaaggctgaaggaaccatagcggacagccaaggtttcatatcttcagctaccaataaccaataaagcaataatataataaaaatggcaatagcaatacctactaagacttttctctgtttcataattgtttttcgtttaaatattcaatatttataagaacagatcaggcagaaaattgttctgtatcagaaaaatgaagaggaaaaagaaaaaaagtaagattttgtttgttgtttcaaacaaagtgtctatatttgtccccgataaataacaaaagacaatgagaacaatgttagtaaatacatattgggctaactacataattatattaagaattaatatctttgcgatgtttttcctttattaggattgaaaaggggttataaatatgacgatatttcaattacaaacatttaatttatacctaaaatgacaaagaagttgtacttgcctttactcatggcaattgttgttgcacttttctcttcgtgcaagaaaatgggtcccctgtcagcggactacttcactgttactccacaagtgttggaagcagtaggtggtaaagttcctgctaccattaatggtaaattccctgaaaagtatttcaagaaaaaagctgtagtagaagttactccggttttgaaatggaatggcggtgaagctaaaggacaaagtgctgtgttccaaggagaaaaagtagaaggaaacgatcagactatctcttacaaagtaggtggtagctatacgatgaaaacatctttcgactatgttcctgaaatggcaaaatctgaactgtggcttgaattcaaagctaaagttggtaaaaaggaagtcgttatccccgctgtgaaagtagctgatggtgtaatctctacttctgaattggtaaataacacattgggcagcgctaacccggctctgggcgaagatgctttccaacgtatcatcaaggaaaaacacgatgctaacatcatgttcttgatccaacaggctaacatccgttcaagcgagttgaaaactgctaaagaattcaacaaggaagttgctaacataaacgaagctgccaacaagaagatcagcaacatcgaagtttctgcttatgcttctcctgatggtggtgtaagcctgaatacaactctagcagaaaaccgcgaaagcaacactaccaagatgctgaacaaagacttgaagaaagctaagatcgacgctccggttgacgctaaatatactgcacaggactgggaaggtttccaggaactggtttctaaatctaacatccaggataaagaactgatccttcgcgtattgtctatgtatcaggatcctgcacagagagaacaagaaatcaagaacatctcttctgtatacaagaacctggctgacgatatccttcctcaactgcgtcgttctcgtttgactttgaactacgagatcatcggtaagtctgacgaagaaatcactaagcttgcttcttctaatccttctgaactgaacatcgaagaattgctgtatgctgctacactgactaacgatcctgcaaaacaggaagctatctatactcaggcaacaaaacagttccctaacgattaccgcgcatacaacaaccttggtaagcttgcttatcaagctggtaacgttgacaaagctgaatcttacctgaagaaagctgccagcgtaaacgctgctcctgaagtaaacatgaacttaggtttgatctctttgatcaagggtgacaaagctgctgctgaagcttacttcggtaaagctgcaggtacaaaagaacttggcgaatctatgggtaacctgtacatcgctcaaggccagtacgaaagagcagttaactcattcggtgacgctaagactaacagtgctgctttggctcagatccttgctaaggactacaacaaagctaaaaacacactggcaggcgtagaaaaaccagatgcttacacagactacctgatggcagttctaggtgctagaactaacaattcttctatggtaaccagcagcttgaagagcgctgttgctaaagaacctgcgttggctaagaaagctgcaacagacttggaattctctaagttcttcacaaatgcagacttcatgagcatcatcaaataagagaattaccactctattttagatattgagaattgctcgtcattacaaatgacgggcaattcttttttttatctgtaaaaaaccgtactttcgcagaaaagaaatcaaagcaatgaaaaagagtagtattttaatcctcatcattatctgtctggtcggatgcaagaagggctccaatgagacaaccatcaccggagagatcaaaggactcggaacagatacactttatttgtacggcatggacgaactgtacgaccggatagacaccatttatgtagaaaacgataagttctcctacactaccagcgtagatacgatcacttctgcctatctgttactcaagaaccggattgaatatcctgtctttcttgataagggtaacaagatcaaaataaaaggagatacgatcaatctgaatttcctgactatcagtggaaatatatacaatgaggagtttacagacttccaaaaagcactggaagatccggctgatccttcagaaaaagccggcgaagaaacagtggataaaagaataactgtagagaaagcaaacactgccgaagaaatggcggaagagttcatactgcaacatcactcctcctatgtaagcctttacttattagacaaatacttcgttcagaaagaaacgcctgacttcagtaaaattaaaaagctagttgaagtaatgacaggtgtattacaggacaaaccgtatatcgaacgtttgaatgaaacaatcactcaggcagaaaaatcggagattggcaaatatgcacctttcttcagcctgcccaatgcgaaaggagaaaagattacccgttcatcagacgccttcaagcagaaaagcctgctgatcaacttttgggcttcctggaacgacagcatctctcagaagcagagcaacagcgagctaagagaaatctacaaaaagtataagaagaacaaatatataggaatgctcggcatctcactggatgtagacaagcagcaatggaaagacgccatcaaacgcgatacgctggactgggaacaggtatgcgatttcggcggactcaattctgaagtagccaagcaatattctatctataaaatacctgccaacatacttctctcgtcggacggaaagattttagctaagaaccttcggggagaagagctgaaaaagaaaatagaaaacatcgttgaggaagcgacagaaaaagaaaagaaaaacaaacagaagaaataaacggtaatcaaacgtgctaattaaagttttcggagcggctgttcaagggattgatgcaacactcatcacaatcgaagtcaacagctcacgtggctgtatgttctatctcgtcggtcttccggattccgcagtgaaggaaagtcaccaacgtattatctccgcactgcaagtcaatggctataaaatgccgaccagtaacctggttgtaaatatggcaccggccgatatccgcaaagaaggctcggcttatgatttgcctcttgccatcggcttgctgggtgccagcgaaaccatatcttccgaaaagttatcccgctatctgatgatgggagaacttagtcttgacgggagcattcagcctatcaaaggagcactgcctattgctatcaaagcccgtgaagaaaactttgagggactcattattcctcaacagaatgcgcgggaagcagcagttgtcaatcaactgaaggtatatggcgtcagtaatatcaaagaagttatccagttcttcaatggtgagcgggagctggaacagaccgttgtcaacacgcgggaagagttttatcaacagcaaacagcctttgacctggactttgcagacgtaaaaggacaggagaatgtgaaaagggcgttggaagttgctgccgccggaggacataatctcatcatgatcggcgctcccggcagtggtaaatcaatgatggctaaacggttaccttccatccttcctcccctctccctgggtgaaagcctggaaacgaccaaaatacattccgttgcaggaaaactaaaccggggctcttcactgatttcccaacggccattccgtgatccccatcatacgatatcgcaagttgcaatggtgggaggcggaagttttccccaaccgggagaaataagcctggcgcataacggagttttatttttggacgaattacccgaattcaacagaggggtattagaagtcctgcgccagccactggaagaccggcagattaccatctcccgcataaagagcacaatcagttatcccgccaatctgatgctcattgcatccatgaatccatgcccttgcggatactataatcatccgaccaaggcatgtgtatgcagtcctggtcaggtacaaaagtatctgaacaagatatccggtccgttgctggaccgtattgatattcagatagagattgttcctgttccgttcgacaagatatccgatcagcgacagggagaagcaagcagtgttattcggaacagagtcattcaggcacgccgtatacaggaacagcgctatgccgatcatcccggtatctactgcaatgcacagatgagcagcaagttattatccatttatgctcggccggatgacaaaggactttccctgctgcgaaatgcaatggaacgcctcaatctttccgcacgcgcatacgaccgtatattaaaggtggcacgtaccattgccgaccttgagggtgcggaactgatacagccctcccatttggctgaagccatcagttatcgcaatctggacagagaaaactgggcgggataaaagcgcttgacagtaaatcaataaaataccataaagaaaaagtcttcgtctcatataaaatactattttcgcaagatagaatctagtatatgaataaacacgacaacccatattaccccctatttctactcatcggatggcttatcatgctgagtagttgtcaacctgccccatctcatcttctggaaaaagcgatgcagatggagaatgtatcaaccgacagtatctttttctacctgcaacaaatagaagaacccgacaaattacctctcaatgatcaaggagattattacctgttgctctacaaggcaactctgtggaaaacaggaacacctgatgattcattattgcagatcgccatccggcaatataaacaaaacgagcagcaaacccagtatgtacgggcacgcattgagcaaagcgcctcctatttatatcgtaatctgcccgattccacattactgatgagcgaacaaatcctgaaaggataccagctaaatgatacgctaaaaacaaggctgtacgggctacgaagggcagcatacagcagaaagcaggattatccgcaggcattggtgatggcagacagcagcagacaactggctcttaagatgaaagatacacttttctatttttctaccagccagctatatctgcaaattataaacaaaatgcaagatcatgacagatacacccaaagctatctgcagctaatgaaagaacttatggattcgcccaaataccagtctttgaattattatgcgctggaaagtctgttgaacaccagtctgcaaagaaaggatttccggcaagcagtcatatatcttcaacaattatcgagccaacgccgcggaagaaatgaagtaccacactatctgctgctatgcggaagaacccatgccgccttgaatcagattgactccgcccaatattactatcggcaagccgcaatctcatcttccagctttattgccatggaagccaatgcacgcttattcaatctgatcaatgaaaaagaatatccggaacaagtcttttataccaagcagaaggaaagcacgataagggacaatatactaaacaatatcagtacagggatacgggaaagagaattcaaccaactcaaattacagaatgaattataccagctgcatctgcaacagcagcaaagggaactatggatgctgggaatcgttacagctctgctgagtatcggattcatcgcatttttcttttatcagagagagaaaaagaagcgactgctgcgggaaaaccagttactgtacaaagaagccgaagtaagtggactacgggagaaagaaatccggctaaggaataaagaggctgaactccgtgaagcgcttttccggagaatgccattcttccataagctgccctcactccatgccaacaacaatcaggacgaaccgggcaccagtcacaagatagtagtgacagatgcagaatgggcagaagtcacttcagtagtgaacgatgcgttcgacaattttgtcgtccggttacgacaggcttatccacagttgggagataaagaaatcggcttctgctgcctcgtcaaaatcaatgtcaacatacaggatttatctgatatctattgtgtgagcaaagctgccattaccaaacggaaatatcggataaagactgataagctgggaattactgatgagaatataagtttagacagttttctcaaagttttttagctgtcgccccagggtagttgaagtctttgtccgcctgaaaacaaacgcatatatacattatattattaataatcaataacatacatctagtcatccatattgaaattgcaatcatgatttccgggagtaaaaattatttgttcatagaccttatctttatacaatgttttaagtaaacttcttattgaattcaaaaactttgaagccaaaatatattcttcttcactaccagagtaaacaacatcacctgtaaacactatatatatgcgatcacattcttcatatatcgttttgacggaagcaacaagagatgaaaactcactcaaaatccaatcagtggcactttttatgtgagaatctgtaaagtgtaatattcctaatttcataaatgacagtttttgcaaaggtaaaaaaacgcccagtttttacgccacaaaactggaatatttttaagtgcatacataaaaaatgatacccctccggaccgctgtcctttgaagtatcaccattcgaacaagaaaagaaacttcatcctgtttcacaactgtatgaagtcattgccatgacaaacaccaatacgcagtttgggatttcctgcctcacggcagtagtttcaccggtacaaagcaaaaacatggacttattctttcggcagcggatagctctcggacagtttgtcctcacgtgcctgccgttttatctcgttctcgtcgaagttgttgcggatgaactcgtgcaagtccgactccttgtaatatgtcttgtgatatatcgaatagaacttcaacaccccgttattccggtatcgttgcagcgtgcgtttgctgatgcgcaacaacaggcatacttcctgattgtcgtacagacgctctccgttcaggtagttcaggtgcttttccctcgtttccgccttgtccagcttccgtgagatgcggtacagctcacccatgatacgttccatccatgcttcaaattccgttttatctactaacatacgctttcctccttaaaagttcccgacaacataatagctctggttatcggatgatttcagaatgatttctttctcacgcatgaacctgatgtagcttttcgccgtacgttccttcacttccagtatcgactggatttcttccgcaagctccacataagtaacaaagcgcctccggctgaatacctctttggccaccgctacaagctcatcctctttgcgcttgtccttttcctctttcggcttttcgcccagatagacgtgcatggccttttccttatcccacgaaaactgcatgataggcacatccagcggacttccatcccttactttcagagccttcaccaccgatatggccggatcgctgtccttctctatggaaaggattgccgcagccttccgctgcaactcgcttcccaagtgtcccctcagcttcagcccgttggggataaaatgcagtaccgtaacgatacacgtcttgtagataccggccagccggtacagctcttccacgacggctatgctctccgcttcatcgttggcgcattttatcaaatccgcaatcccgtctatcaccaccagatgaacaccgccgtattgataatggtacttgtccaagctctggataatggaaagcaggcgttctttccggctcattcccgtaagacaatacgccttgaaccattccggcatcgcctcacgtccgcatcgccgcagcaggttgctgatattcttatacagctgtacttcgctctgttccgtgtcatagaacagtaccgccttgttcctgctgttttcgtggagcgtaacgcccagcgcatccacatccgttccggtgggacggatagcaccggcaatcagtgccgccacatagttgctttttcccgtgccttctccgccggtgatacaaagcaggttgccttgagttccgagaggcacgtcatttaccgatacgatcatctgtgcaatgggaggcgggttgttgaaatccacctcgcaggatttcaaagccgacatggtttcactgtataaggtttccagatagtccagaaaaagttttatcaaatcctcacggctgttccccagcatgaagtagtccgatacatccttttccgtctttgtaccggcaagcgggagcaacaatcgtttaatcccgtattccttcagctcctcttcacgcttcgccgagcttttcagtccggtactgtccacatcatagaggaggatgatatgcttgaaccggaacgaaagccggtgtatgacagccgcagggataaaagccgtttccgaattgaaacagatcgcatggaagccgtgtgccgccaggctcatcacatccttttccccgcctgtgataaagagcagatcaccctttgccggcagctgctccagcccgaaacagtagttgtcgccaaaatcaccggcgtacaggaaccgcatttgtgaacacggacggtaaaccttgatatgctgtttccccatatatccgaacatcggttcatcgacgcttgtcatgcaggaaaaaggcttcctttcctggttctcgctgctgaacttcttcagcgataccgtccggtacgctttcagaacattttccccgattcccgatttaccccaaaaggcaagttccgcagccgtaaagggcttttgcacgacagtataaggccggacgcttttcgctttcggttcttccgataccacttcactcttttgggggactttgctatggctcacatgatattcctcatgtgcggacagccccaaatgcagatcgcggtttatcatttccatgatctcgacaaactctttaggctccttgcagctaaggccgttcagcctgcccaccagttcaaagcagtcccctgaataatcctcgttcccgaaatccttcattttaaacacaccggccttgcgttcgtaataaatattgcacgaagccttcgtatccttataaaaagggttcaggaagttctttcccaccttgaagtccaccggcaggtaatagcggaatacggaaatgcccttttccgtcattttcagtatatcatcctttcttatcattgccggttctcgttaggtagttcttgcgaaaatcctccaatgtttgaggcttgcaccgaatggtacgctcttccagacagcgttcgacctccgacagcttgtacatacaccgtccacgcagcatggagtagctgatcaggttttcatccctcaggcgttgcaatgtacgtgtactgatccctaaagcttccgccagttggttgctgtccagccaagtctcctttttttcttccgaaggcagctgcgcttcggctacatacccggcgattttttcaatcttccctacaagcgctttatacgcttcactttcaaatgtaataacttccataacaaacttaatttttaatgtttgctgcaaaagaataacaataaaaggcagcgcatgggatactatacgtgtactacaccatgattttttcggttcagcgaaaaaggagggggaaccacttcacataaacggcggtatcgaggcggacggaaaggctgtaggactgatgcaacatccgcccggtgcaaggggcaaacctatccatatatataggttcgccccttgcactagggatctttttttaaagatttaataatcaaatgtttggaaaataaaaagtaatgctctatctttgcggcatcagagaacggctgacaaacgaatgcctctcactgacaacaagcgttcctataaatcgttactaattcgttacggtacaattttttaaggtttacaagagcttataaatcaaagatatagaccgctacggtgaaagccccagctggatcactgaaaacaaaagaaaaatcaagcaaatccctgataatcaagtattatcggggatttcttttttttggcaggtagcagaaaatagccgtttcaagcatattatcggtggataaatcgtgggactaaaatttaatcgaaaaaagtcccacgaatttgcatctttctcgctgattcatagctttttgcatggtcgtactttggaagagaataattaaagaacggtgaagcactcgtatgcatgagaatcaccgtaaatggctgtatagtagacatttctatcaaaagaagctgtcctgtagacctatggaatcaggctaaagagaattcaaaaggcaaagaccgtatgtcggtggaaccgaaccactacttagaaatcacacgttcccacgtacatcaaatttatagagaactggaaacttccggcaaggttatcactgttgatcttgttagaaaaccgtattatgatgtggacgaagataacaaaacgctattacaggtattcagggagcataacgaacaaagccgcaagctaatcggtaaagactttattagtaaaaccgttcaacggtatgaaaccactacccgatatttggaggaattcattaagaaagaatatcagttatcggatattgccctgaacaacttggaagccaacttcatttctaagttcgatgctttcttgaagattgaaaaaggttgtgcgcagaactccgctatcacccgattaaagaacttaaagaagattatccgcattgccttggaaaatgactggataaagaaagatccattcgcttactatcgtttcaaactgaaagaaacatatcctgaatttctgacaatggacgagattaaaatcattctcgctaaagagttcacaattaaacgagtagaacaggtacgagacgttttcattttttgcagttataccggtttggcgttcagcgatgtgaaagacttatcacctgaacacttgctaaaagacaataaaggagaactttggataaaaatcttcctctcatttcattcgagcgtattttcatctaaaaacttgcacagactaaatacttcactggcaaagtcaatgattcaaattaaattctgaaaaaaaatgttctcagggctagcaggttattctttccaaccttcaaagtaatgcttttggagcaacttatcaatatcactttgacgatagatgattttaccttttatctggataaaggggattagccccgtatctcgccattcctgcaaggttcgtagactgacattcagtttcttggaaacctcattattagaaagaaaacgttccccgttcaagtgtggcttgtagtgctttacaatagattcaatgccgtccagcatcgaatcgagcgaagaaataaattctttgatttgtagggtatctttatttattagttccatgactgaaagattgttttattgaaatattgatttcaagatctctagatagcaggctagttgcgcagatagtcccccaatgatgagatgctaagtacatcttttgccgggtcataatctacagagagccgtttggatgcagtggcaataaaatactggctaccatcttgctgtatctcataagtagcgggtgaagcctgcttggtggtttccgatacatatacaatagaaaggagatattctttaccgttccggtagatgataaccgtaggattcagattaacgctttcccatgtgccgacaatggaaaacagattgaaggatggataatcttcattagttcttttcataagacatgatttgtttgggtgatagtttccccaataacacttaaatcttcatgataaatatcatgagcacactccaaattttactatattgcaacaatttataaatgtagtcagcatgaagttcaaagacctttcaattacgatccatacaaataaagtaaaggaatgcatagatttctacaccgaatattttaaagctatgtcagcttttgatttatagtgagagatagccgatatataaagttgataaagtaataatctaagttagcactcgtaatttgaaattggaatacaacataagaagcctgtacactccagtacagccagcagtaataggaactaatggcgaggtctcatatattgagttgccacctgacgcacaactacaagactttatttattgttattggaatctaaagactattaagccactagatgatatatacaattatcgtgtagttgctgatgggtgtattgatatcgtttttaattgtacaaattatgatgaaacatatataatggggtactgcaattcttttgtgaagattggcattgataaagaattcaattatttcggaatacggtttcttccgggtatatttccgtcactatttaatatagatgcgtcagaattaagcaaccattacgaacgtttaaataccgtgcaaccttgtatatacaatgtaattcaacaatcgaaagatagatgcttatgccttcaggatttgtgcgatgaactcaatatctattttattaagcacataaataaaatagataaaccttttgataatagatttttctgtgcattagaaactattttaaaaagcaaaggatcgattattattgagaaagatttgaatgatggaataagtagtcgtcatttacaacgactttttaatttttacataggagatacagccaagtctttttgccgaattgttcgttttcaaaatcttttaaagattgacccttcagttaaattaataaaatccgaaaaatcatattatgattttggttactatgaccaaactcatttcataaaagagtttaaattattttacggtaaaacgcccttaaagatcgctgctgaataaaatgtccgatttttcctatttttgaaaaactctatgttttaacttcgcggcatggaattacatagcataaagcaactgtcaatactttatgtaataaccagtaaagatgaagttaaatataaccagcgatttaataaatcgctaaaaatataaaagcaactattgaaatatactcgaaaagtattcatgtttctattgataattcttttaaacatatgaaaaatgactcatttttagataaagttattggatcactcctttcacaaaattttcaagtagattcaaatgcttatacttatggtttagtaaagggtaaaaatgattccttctctgggaaagtgattgacggcatagatgtagccaaaagcatacttgctatagctcaaatttttggttccccaattgattctgattgtgctgattttaaaacgatttttaatggagaaggttttaagaaagatttaaaggctttgtattctatgacagatgccgtgctttacaaatttatattaggacaacctttaattgtaggagtagtgaaagcagacagtttaacgcataatgaaatctatgatattactgataaattcgataaagcaattcttggttttaggaaatacacagcgcgtatgaaatggactaaatgtcggtaaccggaatacttttgtttttattttacgataaaaataaagcaaatagctattgtttatgtgcacaacagaattgtaaaagatggcatttctggaaaaaacatagacactaggttgggcgatcgatattaatagtaagaatattataaaacataaaggaattcctttccttataggccctatattggatacaaaaaaatttcagaatgacttgtttggaaaataaaaaaggatgttcaccaatgttgtttcttgcttatattttaacaatgatgaccaattcaactaatgaggatagctatagattttgacggaacgattgtggaacacagatatccgcggatagggaaagagattccttttgccattgccaccctgaaacagttgcagaccgaacggcatttgcttgttttatggacggtgcgtgaggggaaactgcttgacgaggcggtggacttctgccgcaagcgcggattggagttttatgctgtcaatgcaaatcatccggaagaagaagtgagaaacgatatgaccagcccttgcaggaaagtcgtggccgacttgtacattgatgacttgaatgtggggaaactgcccgactggggagctatctatgagatgatacataatcggtggagttatgaacgctatttgaatgaaattcatggctttgagaaacagaaaaagatttccatttggaaacggatatttaggtaataatttacagattgtagattcgtcgtcagataagttctttctgctgtcatttagatgctaatgaccacacaatcggaaaacacgaggcgcatagccaagaacacgctgatgctctacgtgcgtatgctattcagcatgttggtatcgctttatacatcgcgagtggtattgaacgcattgggagtggaagactatggcatatataatgttgtaggcgggtttgtggccatgttttcattggtttcctcctccttgtcatcggcagtaagccgttttctcacttttgagttaggcaggaaaaatgtggaacggcttaaattgatgttcttcacttccttgtccattcacatcatattggcactggcagtagtccttgcggcggaaaccgtcggtttgtggttcttgaatacccaaatgaccataccggccgatcggcttcatgcagcaaattgggtatttcaggcctccgtctgttcatttgcactgggattgtgcagtacgccgttcaacgcctcgatcgtatcgcatgagcatatgggtacttttgccaaagcgggaatcatggatgtgatgctgcgtttgctggtggtattgtttatagcctgtccttcgtggcattttgaccgtctgataatctattcgttgctattggttcttgtcagtatctctttgcagtgcttttatttgtattattgtggcagacattttgaggaatgccggtggcgtttcagtttcgaccgtccatgttggaaagagatgagttcgttcgcggtatggaactttattggttgtaccgccggattgttgaaagggcagggtgtcaatgtgttgctcaatatctttgtcggtccggtactgaatgccgcccgaggcatagccgaccaggtaaatgctgcgatctgctcgttttccggcaatttcatgattgccctgaatcctcaaatcacgaaatcatacgcttctgacaatcgggagtatacaatgtcattggtagagcgcggttcccgcttctcgttctatatcatgtttattttggccttgccagtcttgttggaaaccgattttatactgaatctttggctgaagcaataccctgaccataccgtaaatttcgtccggctggttttgctgctgtcacttagtgatatactgtcgaacaccttgatcacactgcagaacgcgaacggtaatatccgcaattaccagattgcggtcggcggaatgctgatgatgaactttccgctttcttattgttgcttgaaggccggtttccctccggaatccacattggtggtggcattgttcgtttccgtttgctgcctgatactccgtttgctttttttgcgccgcatggttcgtctttccgtcaggcgatatatacggaatgtatgtcttaacacgttcactgtggctgtgaccgcttcctgtttgcccatattgctcagtcggcaaatggaagacggttggattcgttttatagtcgtgtgtgtggcaagtgtgtgttgcgtcggagtctcttcctattttatagggtgcggctcgtccgaacgcgcgttcatcgtacagacgctccacggagtaaagactaaactgctgaaatgataaaagtggaagataaatcgcgttgctgtggttgcgaggcttgtgtgtcaagttgtcccctgcagtgcattgagcttgtaaaggataaggaaggctttatgtatccgcaagtagatacggcacgttgcattgattgtggcaaatgtgagaaagcctgccccgaattggttgaagccaagggaagcgggggcgtcactgtttatgcggccgtcaatccggataaggaagcccgtcttgccagttcctccggtggcattttcactcttctggcagaatcggttctcgcggagaatggtgtagtgtttggcgcacggtttgacaaggattggaatgtcatccacgattatactgagactaaagagggactggaagcatttcggggaagcaaatacgtacaaagccggacaggcgaaactttcaagcaggcggaacagtttctgaaagagggtcgtaaggtgcttttctcgggtactccctgccaaatcatggggctgaagagatatcttcataaagagtacgacaacttgctggctgtcgatttcgtttgtcacggtgtgccgagtccattggtatggaggaaatacatagaagaaacactcgtccgtcaggacgaaaaaattcagtttcgtcccaccttaaaccacttgttcttggacgagatgccccttatagagggtatctcgttcagaaacaaatgcttaggctggaaaaaatacagtttcgctctcatcctctccaaggtgacaaccgccggagagaaaaatacagtttcgctctcacgtatattctacgacaatgcctatatgaaggcatttttggcgaatctctccttgcgccccgcttgttaccgctgtcccgcgaaatcagggaagtccggtagtgatattacgctgggtgacttctggggcattgagaagattgctcccgaattggatgacgaccgtggctgcagcctgttgattataaacaatccgaaggtgagggatgagttacgaaagaaaggctgtttgttggcggaatttcccatttcggaaatcttgccgtataatctgagcacagcttattcggtgagcatgccgaataacaggaaatttttttggttcatgttcgataaagccggcttccataaggctttaatgttggcaacaagcacaacgtttcccattcgtgcgttgagaaaacttttcaggctaatatgaaaataggaatattgactcaaccgctgagtaacaactatggtggcatattacaggctttggctctgcaaaccgtgttgcggtcgatggggcatgagacagttattctcagtcgtgaatatgactatccgccattccggctttgcctgatgcgtatattgagcgtgttgaagtgtattgttcgtaagtatatattaagggacaaccgtgctattattgccaatccctttttacacttctatgcaacagataagacacaggtttatgacgataacgaaatacaagcgtttatccggaagaacttgaaatgttccgtccggctacagagtacttggatattgaagatctatgtacgactgcatcattttgatgcttttttagtgggaagcgatcaagtatggcgcgagtctttttctccttgtatcactaatttctttttggattttctttcacagaaatgcagagccaaaagaatagcctatggggcttcatttggagtggaacagaatcctatctctgtagcttcattgaatcaatgtgtagaactagccaagcggtttgatgccatatcggtacgtgaacagtccggagtaaaaataatgaaagagacctttcatctgtcggcttgtcaggtattagatccgactttgttgcttcctgttgatttttatcgttctttcatgcagaaatccgatatggattcatcgggtttggtgagttatttgcttgatggtaatgaagagaaaagaaatatcattgctgttgcacgagagcaattgcaattgtctcagaccgaattattactctttccatctcgatacaaagatgaagtgcctcgattttcttctgtttcttcttggctttccgcttttgctaatgcggattttgtagtgacagattcatttcatggttgtgtgttttctattatttttcgtaaaccgtttgtggtaatatctaattcgggcagaggaaatgaacgttttttttccttgcttgatactttcgggctaaatgatagattagtgttctcgtatgaagaatttgttgataaagaagaaattttgcttattgaacaagattatacagaagtagaacgaaaatatgagaatttaaaagttaagagtcttgagttcctgtttcaagcgttaaatgagaattaagattatagaaatctgtataaatttaacaaaatgctttttccttttgtactcccagcatataaggctacttatttaaaggaggtaatattaagtatattgtggcaaacttataccaatcttgagcttgtcattgttaatgatgcttctccaaaatatttggattccatcgtcaatgaatttgataatgatagaatattaaaggaataatatgaatttaatgccacaaattactatcatagtaccggtttataatgcggagcggacccttgaaagatgtgtacgttccattcaagcacaaacagttgtcaattgggagttgctgttgattgacgatggtagcgaggattactcgagcaaattgtgcgatgaatatgcgatacaggattcgcggatacgtgtatttcatcaagtgaacgggggagcgagttctgcaagaaacgtgggattggaatatacaaaaggtgaatgggtcgtattttgtgattccgatgattgggttgatagcaactggttggaactatttaaaaatcaaattgataatggcacggaattaattgtacagggatttattcctcatgggaatttgtggcagagccgaaccggcataaattttcatggcaatgtaaaaactggtatattgaaattgcaggaggagaacatattgggttttatgtgtactaaaatgtataaacgtgaaattatagaacaatgtggcttgcgttttgataccgaactcgtattgcgtgaggacgaattgtttatgcttcaatacgcagaatacatttctacaatacaatgtatggaggaaggtgcctaccattatgatatgcctgatttttcaaccaagtatggcaatatagatttgtttaatatgtttctcaaaatatatgtggttctgaaaagaatattttcaggagaagacaatttgttacttcagaattatgaaaatgatttgactcaatcactttttcattcttttgtaatgcgtcatgacgatagatgcaaaaaattggaaaactatcgtaaggaggttggaaaacgagtattgggcgtgaaatcattgtcgcaattctcgaaatatatattggcttatgtgccttcttttcaagtggcatatctgttacttgaagctaaagcaaaaatcgttaaaagtatgcaatgaatcaaaggtggcctgattataattcaatagcgcataaggatttccaattcttatgtatggactatgtacgttttgtccttgccctattggttgttttgtttcatgcatttgctctaagcagtatatcggcattttccgatatagaatatcccttaataggattggtaagccgtgtgttggatgcattcttggcacatacaatcgttcctgtttattccttcatatccggttatcttttttttcttgttaaggaatggaacaaaaaggtttattttgacaaaatcaaaaagaggatacatacgcttttgataccttacctgttatggaatggtataggtattatacttgtagccattaaacaattgtcctgctttgacacttttatttcagtatcaggtacttgcatagacttttcatttcagaatatcctgtcttgtttttatatgtataatggcaaacttagtgtcccgtctgctataacagattatgcccaactggtgcaaacacaatattatccaattaatacagcattgtggtatgtccgtgatttgatggtagtggttgtctgcactcctgtattatatttcttgttaaaaaaaataaaagcatatttgattttcctattcaatttctcagctgaggatacattagtcttatatcatagtgtagaactcacattattagtagctaaactaaaaagacttgtaaaaaggaatgtaattattgaagtagaagagatctatggttattctgcggttactgatcgtccatgggtagaagatgaaatagattccattaaaaaaatggatctacatatttgtgtcaacgatggaataccacaaggcttaaaattggaaacaggtaaatttgtcgtcagtttgggtgtcgggaatattccaactagaacaatagatcgtttcaatgatgggaaaattcatgttgtgtatgcaggtacaattgagatgaaaaaactaggggctatgactgctgtagaatctgctaaatttttaccagattactacattctgcatattctaggatttggatctgaagaaaacatgaaaaaactcaaattaaagatttcagaagtaaataatgatgtgggcagtgaacgtatcaaatatgatggctataagtcgggaaaagaacttgatgacttcttattttcttgtcatatagggctcagttcaaatgttatgcgtccaaatttcgccaacaactctttcccgtcaaaggtaataacgtatatgtgtcacgatttgtctgtcgttcttggatatgcagaggctttttacgacgttccgatgtccagaggctggcagttctaccatgaatacacaccagaaaagatagctgaagcaattactaaagtagagataaaacctattgggtattatcatccttctattataagaatgaatagtaatcttcaagcattttttaagaaatattgttgataatgaaaattgcaatcattacattttttgataacggtaattatggttctgaactgcagacattggcaatgaatgactatttgaatgcaaaaggtcatgtgacggttttctgcaaggtaaaatcatcgaataaaattattcgtgcaatagaacttctatatgataaagtcttattgaaatggtataagataacagataaagaaaagagacaatatcttacagacagagctaaaaatctatcctctcaaagaaatataccacctaaattgaggcagtatattcattcttttgtgaactctcatatttcgtttggatgtataagtcgcttattactctttagaaaagagcgttttgatgcatacatttgtggaagtgatcagatttggtctgctttgaaaatgcctttactaccgttaaatttcctttatggtatcgataagaagaaaaagatagcatatgctccaagtattgggttagataatccaccgtattattacattagagaggtagaaaaatatgtaaaagattttatttatctatctgttcgagaagaagatgcaaagaatgttctcaaaaagcagtatggtattgaagcgatgcaagttttagaccctactctattacaagggaagggattttgggactcattattagcgatagaatctaagcaggtgccaacaaaaccatatgttttctgctattttttaggtaaattaaatgaagatatagtcacttgtataaatagaatagcaaatggcaagtgtgttatggtgcttccgtatgaagaagattgtgaccttatcaaaaatgggaaatatgaacttgcggatccccttgattttgtaaacttgattaagcatgcggattatgtattgactgactcttttcatgggagcattttctctattttgtacgataagcagtttgttgtcacaaaacgaactcatgttagaagagtttcacaaacttcacgaattacttctctcctcaaaatatttaatcttcaaagccagtattgctctggggttgatgaaataattaatgcactacaaaataatatagactattcttttacacatatacaacttgaggaagaacaaagaaaatctaggctatttcttgacggtgcacttaatgaaatagaaaagaatataaaatcatgaataaatatctcaataatataaatgcgtcgtattgttgcggttgttctgcatgtgtacacaagtgtcctaagcaatgccttagaatgtcacaggataaggacggcttttttttccctattgtaaacaatcgtgaagcttgcatagattgcagcttgtgtgcaaaggtttgccctatggaaaatatggttgagtcagattatcctcacacgttctatggtgcttacaatacaaacaaaacagatattgtgaatagctcttctggtggaatatatccatcacttgcaaagtggataatttcacaaggaggaatcgtttttggagcatcattagatgatgagcataagctataccacattggagtgtccacagaatctgatatacaaaaaacaattggttctaaatatttccaaagtgaaataagagatacatacgtagagtgcaagaaagaattagataaaggacgattggttttgtatacgggtactccttgtcaggttcatggactgaagaggtatctaggaaaagattatgataatctttatacagcagatgtaatttgtcatggtgttccaagtagtaaaatgtttgatgcttatatcgacttccttgagaaaaagcataacggaaagcttgtggatatcaatttcagagacaagaaaaggaatgggtggtctattacacttagatatactattgaatattcaaatgacaaaagaaaagactactatctaattaacaagctctcagaatattttatggcttttctcggtggctacattgaaagagagagttgttattcttgtcccttctcttcaatgcgtcgccctggtgacattactatgggtgatttttgggggtatcagttcaagaggccagatctgaagcatgatgaaggattgtcattgattatagtaaacagtgagcatggtaaaagaatagttgatgtccttcacagaaacggagtacaatttaacgctgtagatgaagagtgtgttaaggctagtgaaaacaagaatttgtataagcctacattacgaccagaggtcagaagtgtggtgtatgatgaattgcagaattttggctttgaatacattgcgaagaaatatttcagacgtacgcagacactgagaaataaggctaaaaactatatgcctgttgcattggtaaatattatcaagaagttaaagtaatgaacttaataatttccatattatttgcatttataatagggatatttgacgggcatttttctgtatttgttgcaggcattgttattacattagcatgccgactgcacttattgtcatttgggggtaatgatttagctcgtggtaaaagactgatggcgataattattcctgtttattttattgctgctttgattttcagttattcctttgacgcatctcatcattttatagtatcagatccgtctcgatatattcaaagttattgtttttcgaatgttaattattacaattttgatcaattacggaactgttatttagagctatctgataataatgctttatataacagttctgtattagccgtttgtacatttgctaacaattatttaggaggatcttctgtactgtttatgacattaatacagacattatttggattaatgtcaataatgatgctgtatagaatccttgtaagacaatttggcttcgaacaagctttcaaatactctcttctttttgcattcggttctcattttttgttttattcttcagttattattagagatatcacaatcgtttatttttatcttgtatcaactgcgataattatatcaaagtttgagataaggaatctgatagttcttattatttgcatactcataacttggggcataagactatattctggactctttttgtttgtgtttttaggttactacatgtatattatttccactactgatcgctctcgaaaaatctccttggtagtatttattcctgcattattggtacttgtaggtgtagtaatgtccttttcgatctttgatcagacggtccaagaaattaatgattattcggaattgtcttttgagaatagtggagatggtatggtctcaaaattgatgaaattgcctcctggtatcagtcagattgcattgttactatttgcaatggtcaaaccattcccacctttttctgtaataagcattgctgattctttctctagttttgtgatgtctagtgtattcacttttaacagtgtattttggttctgcattttttatgtcactataattggaatgttgtttaaaggcttttggggaaagatgaatttttctgagaaacttcttttattggttgtattagtatttctcatggcgaatacagctcatgctgacgtaaggcgtatgatgccagtttttccaatattgtatatttgctttataaaaatgaaggaagaatctggttctaattggatgaaacaattgactatagctttgctagttttctatttactaatcggatttgttatgtaaaatagtcatacgattggtatttgaatgttaatttatgttatgaataaagtttatgcaaatctcaaagagtacttgttaaaaggaataagtgctctaaaacgagaatatttcactaattatagaaagcggttagggcattgttcgccaacagcttctcttgtaaagccgttggttattaagggggccaagaatgtgtatttgtatgaagatacaggtattaaagatgccctaattatggcgcctaatgcaaagttcataatgaagaaacactctggtgccgctgaggggcttactgttattacaggaaatcatgaacgccgtattggtcgtttttatagaacgataacagaggcagataagcaacttgtagataaagatgtaattgttgaggaagattgttggattggtaccagagttgtacttttgatgggggtaacagttagacgtggtactacagttgcagcaggtgctgtagtatccaaatctacggctccttattctatagttggtggtactcctgctaagcacatcaaattctattggacaattaatcagattttggagcatgaggctatactatatccagaagaggagagatatacaaaggaacagctagaagatttttttgaaaaatatcagaagggataagaatatgctaaaaagaattctatcaatattctattcaatacgcagatctcttttactgcgtatgcaaaaagcgtacatatcaacacatgtagattgcaaaagtgaaccaagagttaaaggagaagtatttctcaatgcaacggctgtgtccctggggcacgatgttacttttttctctggagcatacttgtggggcacaaatattaatataggaaatcgtgtccaaattggcatgaatacggtaatattctctaaaaagggggtgactattggtaataacacttcgattgccggtcagtgctatataattgatactaatcacgggacaaaagatggccaattaatacaagatcaagcagatgaagtggctgaggaaggtattgttataggaaatgacgtatggattgctgcccagtgtatgattctcaaaggtgcaaagattaacgatggtgcagtaattggtgcacaaacattagtaaattgtgagattcctaagaatgcaattgttgttggaacgccagcaaaaataattggttatagaaaaaaataacataatgacatatcacaatatcaaaactaagattcaaaataataaaagtatcgttataaatgtattgggtgcatttataataaagggtttgggtcttattgttaatcttattgcattaccgttatatatatcatattttaacgataatgcagtgcttggtgtttggtttaccatattatctgttcttaactggattctctcttttgatgtaggtattggtaatggcttgagaaatcatttaacagtagcgctaacaaataaagattatgaagaaggtaagcgtttaatatcctcgtcttatttagtcttgggtgcattgacactatttatttctgttgttttttacatttttcttccttgtatagattggaattcgttttttaacatatctgatagtgtgatacttgcggattcactaatgaattgtataagagttacacttataggtctgttaatatctttctttttgcatttggttaggggaatgttattttctttacaactggcatctataaataatctcatacatttggtgacgagtgtgttgcttgttgcattcttatttgttgttcagccagataatcttgtggaggaaaaacttaaactaatatcctatgcttatgctattttgattaatattccctttgttgttgctacaatttggattttcttattttctgagctaaagaattgtagaccatctattcgatatttcaataaagcagcatccaataaagtactcggcttaggtgttgtgttttttttaattcagattttatatatgataataacagtaacaaacgaatggttcatcacaaaattcttccatcctgaagatactgtaaattatcaggtgtattttagaattttttcacttgttggtagcttactccttttatctatggcgccactatggtctgccataaccaaggcatatgcagagaaaaaatatagttggattattaagatacaaaagtttttatatttcattgcatttgcatgtatcatcttggagattgcaataatcccagtgttacaacctcttgttaatttatggttgaaaggaaattcaattactattgactattttacggcaacatcgtttgcattgtatggtgttattacgatatggattgcaattcaatctacaatcgttgcaggattaggtaaattgaaaatacaattttggttatatttagttgcggtaattacaaagattatacttatagtggtaatatcaaatttcacagaacggtgggaacttgttatgtgggccacgggtattggactattgccactaattaattaaatcataataactatgaagtattatttgggaatagacataggtggtacacatataaaaggtggaatcgtcaaccttctaacgaatgacattcatcaaaacatactatctcacgaagaactgaatgccacagattcaacatcaagcatcattacgaaagtcagaaaagttattactgacattcaagcctgtatgcccctatctaaattaggcggaatcggtatagccatgcccggtccttgcgactatgccaaaggtatagttgccatttatggtgtgccaaagtttcagtcacttttcggtcttaaccttaaagaagaaattaaaaaagtatctgacctgaatactgttttcataaatgacgcatccgcttatgcccttggagagtattatgcaggagcagcaaaagacacaagtagaagcattatagtcacaatcggcaccggacttggaagtacatttcttgaaaatgatactgttttgaacgaactgacagaaggaatacctgaacatggatatctctacaacataccttaccgagacggaatggcagatgactttttttcgacaagatggtttgtaaatacatggaatatgctatttccagataaaaaggtaactggcgtaaaagaaatcgcactacgcgcttcgaacggagacaataatgcacagtcattatttgaaaacttcgcttcaaatttcgtagaattcataaccccattcctgctaaattttaaaccggagaaacttattataggaggaaatatagcgaaagcttctgacttctttttagataatattcagtttcaattaaagaaactcaatttaatcactaaaatagatatctgtaaattatgggatatgtcgccattaatcggatctgctatttacacaagcaacatacttgaaaatatggaaaatacaaaagagaaaagacacacacagcaatttattgcacctactaactctactgccaccccatcaggagaatatgatatatacccggcatttccattgggaaaaggcaaaattgggaaaggtataaaccaactagctgactggatagaaaagcattcccaaataaaaatagatggttatattggagtcttttgggatgaattaatcattaagttaggagaagaactcagaaaaagaggaaagaatgtgcgattctttcattccagtgtagcaatgaaagatccacagactattgaaaaaatgattgctccttatcttggaggagataatccgttattcggcaccattactgataagcatttggttaattggtttgatgaaaataagcttaattccatacaacctgacccggaagcagatttaaatatatttataggtacaggagcagccctatctcaatggaaagctcccctgatttatattgatattcctaaaaatgagattcagtttagaatgcgcgccggagccatcaataatttaggattagattatcgaaaagacaatcaacaggcttacaaacaactatattttgtagactggattgttcttaataagcacaaaaagcaatgcctgcctctgattgacctacttattgacggacaaagagaatgggatgaactattaatgatttcaggaaatgacctacgagaaggattgcacaaaatgagccgcaatttcttcagagttcgtccatggttcgagcctggcgcctggggaggacaatggatgaaaaatcatattcaaggattaaataaagaagtaaataatctggcatggtcttttgaactgatggtacttgaaaacggactaatgctggagagtgacggatatcggcttgaagtatctttcgattttcttatgtatagtgattatcagaatatattaggagaatgttcggaaacatttaagtacgatttcccgatacgtttcgactttctagacacctttgacggagataatctttctatccaatgccatccacgcccccgatatatacaagagcattttaacatgccattcacccaagatgagacatattacatattggattgtaaaaactcgccatgtgtatatttaggctttcaagacaacatcgtccctgaggaattccaatataccttggaacgaagtcaacaaaaagcaacgaaggtagagatagaaaggtttgttcaaaaacaccaagctaaaaagcacgatttctttcttattcccaatggcaccatacatgcttcaggaaaagattgcgtggtattggaaataagtagcgcaccctatattttcacatttaaaatgtacgactggatacgcatgggattagacgggaaaccacgacctctaaacattcaacacggaatgaataatctatattttgaaagaaaaggggaaaaagtaatccaggaattgatatgccatccatatatcatgaaagaaaatcaggagtgtactatagagcatctacctactcataaagagcatttttatgatgtatatcgttacaccttcaaagaccgtattcaaatgaatacagaaaatacatgccatgtatgtatgatagtagaaggagactccgtttgcattgaaacagaggacggcatgaaacaacgctttaattatgcagagacttttgtcatccctgctgctgcccgatcatatacaatcataaatgaaaatcccgacaaaagaataatgttggtaaaagcctttgtaaaaaaagaagttactttgaaataatgtcttaataaaaacatcttatccaactactatgaaacgaactattgtacaaattatctttttcatatattgtattgcgaatgtatatccacaatacagcacaatctggcaacttggcaaaacagataattcatccaaggagtttgccttagcaccggatggaaaagatcgatttattatctccggatttggggataataaaaaatatttttatgcaggcgaacacacaccggccgattttccatacattataccggggcctactgctgaatgggctggctcatcttactgggcaggacaatgcaggatacaacttcctattttaataaaactatccgatgtcaatccgctaaagaaatatcaatggaatatttttatagagaatgtagaatacgaagactgtatgttcttaagactggaagtcaacggaaagaattacgattctcctataaagcctggcaccaaacagctaacatattcaatacagcccggaattctaaaggaagggtacaacaagattgtaatgcagttattcaacggtaaatccctaacttttgacgccatttgcctaaacggacctcaagagacacaaatcaataagataggtgatactcctattatttcaatgaaaatggctgattatgaattagaacaagggaaaacaagaacacagcctcttctactgaaaactataactaaaaaatccggaacacttaaaatacaaatcaaccaaaagaagatattcaaacaagtagaagaaggagagaatatctacgaaattccaaccggaaaacttaaagaccagtctaaaatcaaagttaaaatatcaacagaaggacaaacagtagcaactcaagaatttatccgtagtaaccagcaactacgcagatcaattgattatgttgatcagtttgctggttccagtggttcacgatggatgataggccccggaccatggatgccatttggaatggtaaaacttatgcccgataacgaagatgcccattggaaagcaggatatgaatataacgttgaaaacataatgggattcagccacattcacgaatggacaatgacaggactcttaatgatgccaactacgggagatttaaaaatacaacccggaacagaaaaacagccggactatgggtatcgctcccgaattaataagaaaaccgaaacagcccgaatcggttattattctgttaatcttacagattataatatccaagcagaattaacagcaactacccgcagttcccttcagcgatacacattcaacaaagcagagcagccacgaatactagttgactttttctttccagcagaatacgactggaatttagatgatgtatacgtaaaaaaagtatctgacacagaaatagagggatggaccttgaacgattgccggtcaacaggataccatggagtacaaagatataaattacattttgtcatgcagtttgataagccattcaaaacaatgaatggctggatacgaaacaaagtatatagccaaattgaacagctacataaatcaaacatgaagtcccgacaggtatttacagtcgaaaataacagtcaagacaaactggacgcaggaatcttcctcgactttaaccttaacactggtgatgatgttatggtaaggacaggtatttcattagtaagcattgataacgcacggctaaatctggaagaagaaatagcgagaccattcggatggaattttgataaagttgtcaccaatcaacaagatacctgggaaacacttttccaaagagtcagtatcacaacagacaattacctcttaaagcaaaaattctacaccaatctttaccgttctatcagtccacggaccatctggaatgatgtaaatggggaatggatagatatgaacggtaacaaagctcttatagacaagccaggtaaaagcgtatatggaggtgattctgcttggggaatgcattggacattaggtccattttataatcttctctatccggagtacatgtccaattggatttacacttacgagcagttctatcgtcgtggcggctggcttcccaatggtaatcccggtatgaaatatttcagagtcatgataggcaatcctgctttgccattgatagtctccggctatcaacatggaattcgtgacttcgacagtcaactcatgtatcgggcattaattcaccaacaaacagccactatgataaactatcccggaggaggacaagtcggtaacgaaagttatcccgattatataaccaaaggttatgtacctctatacgatgacgcatgggattggaattctccgcattatcaatcatacgtttccaatacaatggaatactcatatcaagactattgcgctgctcaatattttgacgctcttaataaaaaagatgacttcaatacatttatgaaacgttctgataactggaaaaacatattcgacccatcaaccggatatgtacgcccccgacgtcccaacggagagtggatcgaaaacaccaacccatatcatgctcccggattttgcgaaggcagcgcttggcaattcacctggtacgttcctcatgatgtaaaaagcctcatcaatttaataggagagcgtcaattcatcgaccggctgaatgccggatttgcaacatccgaaaaagtaagcttcaatgctttaggagataatatgggagcttatcctattaatcatgggaatgaaacaaatatgcaggcagcttacctcttctcttataccagtgagccgtggcacacccagaaatgggcacgtgctatacaagaaaaatattatggaatgggtccccgagacgcctatccgggagacgaagatcaaggccaaatgagttcttggtacatcttaagcagcataggacttttccaaatggatggcggttgcagcaaagatcctgtatggttactggggagtccgcgatttgaccgggtagaaattctgttagacaacacctattactctggaaaaaaacttatcataaaagcagaaaatgtatccaaagacaattgttacattcaatatgtaagattcaataacaagcgccttagtaataactatatagaatggagtaaactcaaaaaaggaggaacacttcatttcattatgggtgaccgaccaaatccaaatgcatttaaataaataaacacatatgaaaaataaaagtaagatactaccagttctttttggtttctttattatggggttctgtgacttagtaggagtatcagtcacctatgcgaaagattatttcagttggagcgaaacccaagccggtttcctgccatcaatggtatttatatggtttttactcatctctattccgatttctatctggatggacaagaaaggtagaaaaacaatatcactgataggacttttatctacttttattggaatgttacttccattacttacattcacacagacagcctgttatatcgcctttgcacttttaggcataggaaataccatccttcaagtgtcacttaatcctttattaaccaatgttatcgctgaaggaaaattatcaagcattatgacagccggacaattcatcaaagcactatcttcttttgtaggacctatagtggccggattctgctctgtttatttcaacaactggatattaatgtttcccatattcgccgccattactctaatttccggaatctggttatttttcactccaataaatgagaaagacgacaaaagattaacatccagtttctatcaagttatttctctcctgaaaaataaaaccatctgccttttattcggaggcatcatttgtattgttggcttagatgtaggaatgaatgtatttaccccaaaacttttaattgaaaatgcagagttgactaaagaaatcgcaagttatggtacaagctggtattttgccgctcgcactttggggaccttatgtggtgtaattctattagcaaagttttccgaaatttattattatcggatcaatatgttcattgtattaatagctttgtcctgcatttattggatacattctcaatatattattttgttattagtatgcattatagcctttgcaatgtctagcatatttgccgtcatctactcgctagccttgcatacattaccctataaaaccaacgaaatatcaggactcatgataactgggatatccggtggctccatcattcctcctctcatgggagtttgcgcagattataccgaaagccaatcaggctccatccttgtcatgctaatttgtgtaatctatctaattttatgttcgtttcataaatttaaaaccatacacacaaagccgcattaacatttattcgtcgtaaataaactgaaaaacaactataataaactttatcaatgagaattctttttttattagtagtattgtcggttacttctgccctacagtcgcaggtagtcattaaagagaatgctattcagagtaagtatgcttttcccttggttacttcgaaagcgaaagctgtagtagtttatgatactgatgactatttggtggtacgtaagactgcggagctttttgtttcggacgtcgaatcagtgaccggacaacaattacggttgacggacaaactgaaaggcgacaaagagattattattgtgggtacagttgagaaaaatcggctgatccgccagttagctgagaagggcaagctagatatctcttctttggaagggacatgggaacgatttctgattcagacggtttcccgtccattccccggagtcagcaaagcgctggtagtagcggggagcgacaggcggggagctgcgtacggacttttttcgctttcggaaatgatgggagtgtctccttggtactggtgggctgatgttccggtgaagaaacataagacgctttatgtcgatgcccccgccactttgtccaagactccttcggtgaagtacagaggaattttcttaaatgacgaagactggggactgaaaccttgggctgccaagacattcgagaaagaaagaggaaatatcggtcctcgtacctatgccaaaatatgcgagctgttgctgcgactgaaagctaatcatctggcaccggccatgcaccccgtttctaccgcattttataagataccggaaaataaactggtagctgatacctttgccattgttatggggtccagtcactgcgaaccgttattgctgaacactgccagcgaatgggacagcaagacgatgggaccatgggattataacaagaacaaagataagatcaacgaggtattgagtaatcgtgtgaaggaaaactgtgcgtatgaaaatgtatatacgctggctttaagaggcttgcatgatgcagctatgggtggcggagatgtgccgatgcgggaaaaggttaagatgctggaaagtgcactgaatgctcagagagagatcattgcccggcatatcgacaaacctgttgaaacaatcccacaggcatttacgccttataaggaagtgctggaaatctattcgaacggactggaattgccggatgatgttacaattatctgggcggatgataatttcggttatatgaaacgtctgagtggtccgcaggagcaaaagcgctccggacgtgcaggcgtttactatcatatatcttatttgggtgttcctcatagctatttgtggtatagtactacccctccggcattgatgtatgaagaacttcgtaaggcgtatgataccactgccgatcgtgtctggctggcgaattgcggagacttgaaaggggctgaaacacaaatctcccttttccttgatatggcttatgatatagacagcttcaatgcggataatgtcgccacttatccggcacgttggctggcaaagatgtttggtgaggagtactacgatacattggaagatataacttgttctcatataaatttggctttttccagaaagccggagtacatgggctggggatattggaataactattggggaggcggagagaaacgtacggatacggagttctcttttgctaactataatgaagcggaaagacgcttgactgagtatagccgtattgggaaaaaaacggaggatttgttagcttcattggacgaaaagagtaaaccggctttctatcaattattatactatccggtgaaaggggccgaactgatgaatcatatgaccatcaaaggacagttttaccgtcagtatgtccgtcagcaacgtgctgccgccaatcggcttaaggctcaggtgaagtgctatcatgatagtctcgaaatcataaccgatggatacaactctctgctggatggaaaatggaagcacatgatgtctttaaaacagaactatgatggtacgagttcctatttcatgatcccattgatggaagaggaatacacacctgttggctttcctaagctggggcttcaggcagaaagcgaaaatttggataaaggaggaatgagttttcatacattgcccgcctacagcacttattcacgtaaaagtcattggatagatatatataatcaggggaccggagagctaagctggagtatcacgccttcggaagactggatactgatctctcagaaaagtggtaagacgtctgcggaaaaccgtatctatatatctgttgactgggataaggtgccggcaggagaaaaggtgaaaggacaaattgatataacttccggcacccagaaggagactgtactggtttctgtattcaatcctgagtctcctgcacgcacagaagtacaaggattgtatgtagaggagaatggttacatttctattccggcagccgatttccaccggaagtttgagagtaatgacattcggatgagtatccttccgggacttggttttgaggggcgctctttgcagttggggaatccgacagctcccttacaaatgtatcgtgcaggtgatgtccccagggtggaatatgatttctatacatttaatgccgggatttatgatgtatatacgtatgttttgccgacatttcccttgcatgctgagcgggactacaaattgccggaacatactaactcggatacaaagtatagtgtccgtatagatgatggttccatttctactccttctacttcagctatcgaatattctcaaatctggtatgatagcgtattgaagaattgcagagtgaataagtctactttgtatgtaaagaagcccggtaagcacactttgcagatacgctgtggtgatccgggcgtcgttattcaaaagattgtcattgacttgggaggaatgaagcgttcttatctcggccctcagagtacaatctgtaattagttctgttttttatgaataggggaaccggatggccttgccattggttcctcttctttttgaggggttcccagcacgggcattccgtctttgtcccagtctatcttctgtaaacggggagaacgggaatcggatgcgccaggagcgtcattcggtatctggcgggcatgatatagcatataccattctttcccatccggagacggagtgaaagatattccgccgggaccgtatacattgttttcagggtcttgttgtagtaccggaaccggagacttcttccaggaagccggattgagtaagttagcttttgcgtctgcagtcagtaatccgacacaataataaggagtccagctaccactggctgaatagaagatgcatgctttgtctttattctttgattcaaaatattggggtgcttcgtttacatgtatcggataggctgttttgctgccatccggatttacccattggcattcccattcatattcaggtttggagatgagaatcctgtcagaagacagtgtccatggattcttcatagtagcgatgtagatacattgggtttcactgtctatccttcgtttttgccagccgcaccatatcatatagcgttggccatcatgttcaaaggtgctggcatggattgcccagttgttgtctttatctgtctgtatgcgtcctttcatcacaaatgttccttccatggggttggcggcttcattctcgacaacataaatctggtgattatccatattgccgtcgtctgcggcaaagtaaatataccatttgttatttatacgatgaatttcgggtgcccacagatgataggagttgctggggtcggtgggtatccatacatctttttgagtagcatgtgagaggtctgttatatcatcggtttcccaaagtatgactctgttttctgagccctgtgtataataatatttgccttcatgaaaaatagcccatggctctgctccacgttcaagtaacgggttcgtataggtatttcctgcggctacagtttctttctctgttgtagccttcttatgctggcaagagacaccgattaataagataatggataataaaaacaatctgcttctcatggtacttctcatttgataatgacaatgcaaagtaagcataaaatattgataaatcatgcaaatggaagtagaatggtcagtttttgttgttaaatgaactgtaatttctgaaacttttctttgttttttctcatctttgcgaagtgaacttttaaataaataatatatgaaacttagacatctttttcttttctgtgtaatttgctgttctgtatctatatctgcccaaaacaaaagtaagcttccgaaaacgagtggtaatcctattttccctggttggtatgccgatccggaagggattgtgtttggagacgaatactggatttatcctacctattctgccgcttatgatgatcagatattcatggatgctttctcatcaaaagatttggtaaactggaccaagcatccgaaagtactttccaaagaaaatatcagctggctcagacgtgcattgtgggccccggcagtaatccatgctaatgataaatattatttcttcttcggagccaatgatatccaaaataataatgagttaggcggaattggagttgctgtagcagacaatcctgcaggaccttttaaagatgcgttgggaaaaccgttgattgataagattgtaaatggtgctcagccgattgatcagtttgtatttaaggatgatgatggacaatattatatgtattatggtggttggggacattgtaatatggtgaagatggcaccggatttattgagtattgtaccttttgaggatggtactatctataaggaagtgactccccaaaattatgtggaagggccgtttatgctgaaacataatggaaaatattattttatgtggtcggaaggtggctggggaggtccggattatagtgtagcctatgccattgcggattcaccgttcggtccgtttgaaagagtcggaaaaattctgcagcaagatactaatatagcaaccggtgctggtcatcattcggtagttaaaggtcccggatcagatgaatggtatatcatttatcaccgtcgtccgttgggcgaaactgcagcgaacagccgtgcaacttgtatagaccgtatgtattttaataaagacggaaaaatagagcctgtccgtatgacttttgaaggagtaggagctagccctttggcaacccctgttcgcgctaaaacatatgctaatcctgtaataaactttagtttgcccgatcctactattataaaaggagacgatgaatattactatctatacgcaactgaaagtattaaaaatgtacctattcatcgatcaagagacttggtaaactggtattatgtaggtactgcttttacagatgctacccgtccaaacttcgaacctaaagggagaatatgggcaccggatattaataaaatcggtgataaatacgtaatgtattattctatgtccacttggggaggtgagtggacatgtggtattggtattgctactgctgataagccggaaggaccatttactgatttgggtaagttattccggagcaatgaaatcaatatacagaattgcattgatcctttttatattgaagataatggaaagaaataccttttttgggggagcttccacggaatatatggtacggaactgacagatgatggtctctctttgaagaaaggtgctccaatagagcaaatagccggtactgcttatgaaggtacgtatattcataaacgggatggttattattatttgtttgcttccatcggccgctgctgtgaaggtttgaagagcacatatactacagttgtggggcgttcgaagaatctgttcggcccttatgttgacaagaaagggcgttcaatgtcagataatcatcatgagatattgattcagaagaataaggcatttgtcggtccggggcataattctgaactggtgacagataagaaaggaaacgattggatgttctatcatgcggtcagtgttgctaatccggagggccgtgtattgatgatggatcgtgtgcagtggaaaggtggctggccgtttgtgaaaggcgctgtaccttccttggagactgctgctccggacttcagataagttttttcatatggctattcatttctttacaatgaaaaatgagcatataaaatgtagttgaagtttaaacaaataaattttatccagacactttatccagaatagaaaaagtattggggaaattgcaaagagaaaactatttatctataggaaatgatggcttttctctttgcaattaactttttctataaaggtgggcttttttttgatttattgttttatttttgtccttgtaaactcataaacttgttatagatggcctcagatatacacactctctctgattctcttttatggaagaggtttctcgaaggagattcgagtgcgtattctcaaatatataatcagactgtacaagagctgttccgatatggtttactgtatacttcggacagggagttggtcaaagattgtattcatgatgtgtttgtgaagatttacaccaaccgtgccaaattaacccctactgataacattatagcttatttgatggtggcactgaaaaatacactctttaatgcgttaaagaaaacatctgattctttttcattggacgaagctgatgagaaagaagaccagtccgaagagcatttttctactccggaaactatttatataaataaggaacaagagaagaatactcatatgaaggtgcatgctatgatgtcctccttaaccaccaggcaacgtgaaattgtttattatcggtatattaaggatatgagtattgatgaaattagtaaaatcacggacatgaattatcagtctgtatctaactctatccagcgggctttggggcgtgtacggaatctattcaagcgagaataggagagaagaatattcagctttttcctgcccatcaaaaaaatatcgaaaatagtttgagaaaagtgagtataaaatcaaagtagaactgttatcctaatgtaaagacaataaaaatgattaattcagaactgaaacatactgatttttcatattatcactgtcaaggataaacagtgtctgatttcctcttgtaatataaggtatatagtcttcttgtaatgttttattaaaaaaacacataataatactattatagtctttaagattcgtacctaagcttgagtattccacaaaattaaaacaggattcaggcttgcttccatatggataagtcgcttctacgacctcttttgcttctttataagccagttcatattctccttcccaataatatacacgtgccaatgccgctactatagcataataattcatacgatatcctctataagcgaagaatacatcactagaagcaatatcgctagaaagtatgcttgatgccaacatacgataacctgtactcatccaaattttatgttcatcagttatatcacacttagctaacatctcttttgcagcttttaaatctctaattatcttagaaagaatctctttactactttcatatggaggaacaatggtaggatatacctctacatagggaatataagactttccatcatctttcgatatggcaggagcaaataaacgaagtaaatcaaagtgtataaaagctcgtagtgccaatgcttctccccaaatcatatttttctcaaattctccctctttgaaaatagaagaactagcttcgctaacattgagaatcaaattattacaattagctatattattataaccaatagaccatatattggaaatgaaagttttcacatccgaatcatcaaattggaacttagccgatttataataagctgaatttttaggtataaaattattatctgtttgataatattgagcaatagcatccataaatccccatgacattgttcgtccatacatagaagaagtgcccaaattcaaatatattccattcaaagcatttcgatatccatctcctacctcaaaaagcttatccccattcacctgattactcggtgctacatccagccaatcactacaacttgtagtaaacagacttgtagccaacagtaatattgtatataatttcttcatattattcatctactttaaactattaaaaactcatcttcaccgaagctgcaaaagaccgtgaatatggataatccaaaccacgttcagcacgtacagtagcaacacggaataaatcatttcctgaaagttctacacgtaacagaccgatacgcgctttcttcaaccattcagcattaaaatcatatcctaaagtaagagagttaaatgtcagcacattataatcttggatgaaacggctagtaggacgagtcactgcaactacaccatcagtctgtaaacgtccataaggagtacaatctccaggcttttgccaacgtcctgtcaatacacgacggtctacattactactttgaatatgtgcattctcaaccttacttaccaatgtagaattataacgctgtccaccaaattcatacataaaggtagaatagagagaaaattgcttccaacgaaggttaaatccaaaagtaccctggagttttggctcttcgtttccaatcacaacttggtcagccgcattccagtcatatgttattgtaccgtcaggacgaagataaatttccttaccatctgctggattgatacctaatgatctcacaccaaaaatagatgtcagagaaccaccttctacatactgcaagtaagtctcactatattttgaatctccttttccagaatcatatttcgcatatttttcttgtacgcgcttattgtactctttcagactatctgagattttagttattttattttcattatgagccatatttgcaaaaactgcaacaaaccaatcctttgcattcaaaatattacttctcaactggatttcaacacccttattcatcacctcaccaatattatctttgtaagaagtaaaacctgtagaactaggtaatgtaacactattaaccaagtccaccgttttcttacgataatatgaaaagttcatctggagtaatcccttaaacatatcaacatctagacctaaatccatgttatgagtcttttcccaacccaatccattatttcccaatgccatcaatgatgctcctagacctgttttaaaccagttgtctgtaactactttataaatagtctgcgcttcatagggagagaagtcaactttaccagtaataccataagttccacgaatctttagacggtccatccattcaaactgtttcatgaacttataattatgcaagttcaaaccaagaccaccggaaaagaaaggtgcaaaacgttgatcagcaccaaactctgagtttccatcgaagcgtacagaaacgtccgccaaataaatattatcaaatgaatagttgaatgtccctaatgcaccgaaaagacggcttttactatccgagttagaaggtaatccagagactttattaccatagcctggagaagacaattcgccagacggaaatcctttgtaagtaataccaaaactatcaccagtacttgaagtagcattaatacctaccaaaaaattcagattgtgcttctttatatttctgttataagataaagtagcagtagcatcccaacttaaactattggaagtagcgatatccaactgtcctgaaaccacattatttaagcctaacaaatcatcattcttctttgaacgcggatcaagaaaggtacgtgcatccgaatttgacttcgtaacactaaattgtccttttaacaaccagtaactgtcgatattccacaacaattctgtattattaatcaattcccaagacttacttcgatcataattcttcaatgtagcttcatacaaagggtttacttctcctgatcctccggtccaaggataagttgtctccaaatatcttccattctcatcaatatattcatcatatggcaattttgaagtatagtcggagaagcttccataaggagactcctgagatttagtataagtatatgaaaaatagtttcttacctgaaaagctccaagtcgataagataaagacaacccaccagccatacggtcgcgataagaacctttcataacgccttctccactattataagaaaagtcagctccccaacgcaaatcctccgtaccaccatccaaatacaaactatgtttgtgattgaatacagtacgaaggggtttagataaccaataagtatcaactccacgaactacattgttcagtttttggttgtaaagtgcatctaaccgactttgttcactaaaaccttgttctggatttgccttaaataaacctgcagcaacctctgtttcaagtttctctcgtgcattcatcatattataatcagttaggtcaggatattccaatgttccggtaaagttataatcgatattgactttaccagctttcggtgttactgttgtaataataaccacaccattcgctgcacgcgaaccgtacatagccgtagcggcagcatctttcaagatcgtaatgcttgcaatacggctagggtccatatcatacaatttctgcacgctgatttcaaagccatccatgataaaagtcggaaggttaggattgttcttcaatgatgttttagaaaggctttgcgcatccaattgtgttgttccaatacccgaacgtccacgaatatacaattccggaacattattcgggttcgaacctgctaaattattttcagcaatacgaaaagagggatcgaacgtttgcaaggcccctaatacatttgttttggaaaccgacatcaactgatctgccgtaaccgtcacagaagtacccgtaaagctatttttactgatctttgcataaccggttaccaccacctcttccaattgctttgaatcgggtttcaacttaaaggtatgcactttatcaagattgagcttgccagtatgtatttccaaagtttgcatgcctacaaaggaaagacgaattgttacatctccttcaggaagtcctaaagaaaaagcaccgtctgcatcagtcattgttccgatatttctttcttttcccagtatcaaaaccgtaactcccggtagttcgccaccctgttcatccaccactttaccttccaacgtacgtgtcttctgatctttcttcttgatgaccacaataccatctttggtagcataagtgaaacctttaggtgaaagaacgcggtccagcaattccttccaaggctcgttggtagcttttacagtcaccggttcaactcctttaaacatctgagagttataaagcatgttgattccagctttctgttttaccgtgtttaaaaatgtttccatcggcacatccttcaaatcaagcgtcactttcttctcatcaggtggaagtgcccatgcactgagtaccatactcaatgcaaaaagacatagcataaagactcttctttttttcataatttttaaatcaaaactcaatattactcattctcatatatcaatatatttcttccgtttattctatagtagatatcgccggttagttctaatgcattcaggaaagtattgatcgtgccatatcgctgcaagtcaccactataagtcaggtcgcgcagagactccttctcataatagacatgaacatcataccagcgctcgaaggttttcatgatatcgcccagccgtttgttattgaaaacatatacaccttgtgcccagccgatatattcattgacatccaccacccgcttttcaatgccacgggaagaggcgactgcctgttcacccggcgccagcgtaattgtattctgatcgggtgtcgagaaatttactttcccatatacaagggtggtatagcacgcatccgcatcattataagcattgatattaaatgccgtaccaagtactgttacttctccgaaacgagtccggaccacaaacggatgttcctcatcctttctcacatcaaaataggcttcaccttccagtgtcacaattcggcgctttccgacaaaacggaccggataaagcaatttagaaccggcattcaaatgaacagtggttccatcagcaagaaggacagtattctctcctccccgtggtataaccagttcatttgacttcaccggactttcatcgacattttcttcttcgtgttgttgtgttgtgacggtcggtcgatatgacagcacccctttattgtatttcacctggacgccgtctactattacatttatatctttcttttgtacatcaatagtgcttccatcgggcaaagtcaacactgcctgtttgctacccggcttgatttgcgcgatacgtgtctgggactcctccactgcctgataatgatttatggcataaaaagaaattcctactgccagtactaccaccgctgcggcagcataccaccatgaccggatacggtggatctttccagcggacgaattctctttttgttgaatttgttgaaggaaatgctcgtaagccttttccgatgaatattttttatacttattaaaagcatctttcaattcctcactatcctgcaatttctcatacacggctttcagttccggatgcatagataaacgttgttccaacacctgctgctctttgtcgcttgcatctcccaaaagagccttttttatcaaagaggcatcttgatatgtgttttctaactttttcataattttatctatttctaatgaggattttatctttgctttactataattatacataacgtccataaatgggtgacaaaaagatgattattttttatgagatactctccgtacgaaaacggaaaagaatgaaaaactatcattatgacattattcagcaacaaaaatgacatatttaacaaatcattcccttttcagaatcaaaattcagccatcaataaatgacaattaggcatcttaaaaaatatttgttttttttcgttgccgctattaaaatgatgtattttttagcttttactaaggagtttgaaactcatattttatcatcatccgtcactttcggacttagctaattgatatacaatgcaataagacacagacatggaacgaacacatatagcttactaaaaatgctaaccaagctttgtttacctgttaaacataacggctcatccacttaaataagccacatcacagtcacttcacccccacaaaagcaaggatgcatagcccggtttctaataaaatataagagcaagaagtacagaataactggaatttgccagcttctcgcgtaagaatttatagctacggcttttctgagttttaaccgtattgatgctgactcccagccgggatgcgatttcatcccacgaatgtccctctattcttagcaggatgatacggcgttgttcggcgggaagctcctcgatatagaaataaagttgtcggatagcttcttctttcacagtcaaagcatacaacatttcctcgtcttcaaaatcttcttcctgaggcaagccattcaatatagaatcatgaatctgatggttgcggatatacaacagtgcattattatagcaggcacgataaagataattagtcagctcacgggagtcggaaaaagtacgtttaccttcccacacggatataaacacctcctgaaccagatcttctacggcatcggtgaggaacaggattttctcgacatatgagcacaaggccgcataatagcgatcataaaagtccctccagattcccttatctttctggttgacacctgctactatcaaatcatctttatcgctcatacggcaacaagattaatcaaacaataaaagactctcttcaaattactgcaaaaactggttataatagatatgacttacaaatatatctgttttttcagtatgtaagttcacccctcatataaaaaaatagaataaaggggcataaaataaaaaaagagcgaataactccgccccacctaaagaatcccccataaatgggattcttttttctgcatctcaatttacctgttacctgaaaactacttttttcctaatacctaatcaaaacaatctttttcctaaaaactaatcttaaaatctaataccttaattttataaactaatactactcttttgttattaccttattttctaatacctaaaaatcttagtagtttcacaactacactgcaaaggtagaggtgttttggaaaacaacaagaattcttactattagattatcacattttttagcactacagtcgtaaaaagacattgttgagcacgattcggctatacttttatctgataaaagtaataaataaacagctataaaagccggaattattctccggctttcgtctttttctcacgataaataaccttatctctctgactgattgtccacaatccgtctataaaccgtacatttttcgtatcatcatcctccacgttccatgcataacctcccgaaggtaagccacgtctttccagaatctcattcggttgttcatcagagaagaaaagttccagacgtgtggaatcggggctgaacactataaaagcagaggcagtgcctccatccacagcttctgtccggatacctttttcaaacaaccggatgcagtcttgctgcacttcacaccatacatatccggcagagccgatacaaccgtgttcatcccgatcgcctccaagtttgagagattgcggatactggactaattttgaggcctgcatccccggtgtatatttaccggtatagaatacttccagagtatcattcagaagcaagccatcgacttcttctttattcgcgttcatcgtactgaatgaaagagtatcattcttgtctgtaacaatcgccactgtattcatggtcgcatcacaaacaatgccttttgaacttgtcatacctgacgaacaacttcccatgaaacacaaaactcctaatgctgccaatactgttctcatatcttttttatataattgttggttctaatatcatgcaaatataaaggatatatggaaaagatgttatcctaacaagcagaataacaaacaagtttgcttttatagaatgcaattccgcatatatttcattcatttgtctatatttgcattattgcgcagttgcgcaaaagaaactttaaaacagaaagagaggaattatgccagagtttgatttttccccaataacagaagggatttataatgttatagagacagaagaaaaagtattaaccagcctgccggaagagacaatcacacaaaaacgtaacaggcagaatcgtactatcaaacaaattctcggacatttgattgattccacctcaaacaatcatcaacggatgatcaggttgcaatacagtaaggatctgcttttctttcctgattatcgacaggataatgatctgtggatagccttgcaggattatcagcatacggactggaataatctgattcagttatggaaattctttaatttgcatatcattcaggtaataaagtcggtagatcaaacgaaactagatagttactggtgtgacttcgaagggacaaaagtcactttaaaagaaatgatagaaggatatttagatcatctgaatctccatattcaggaaattcacgaactgatttagcagcctgtttgctatatgatatagtagaggacagagataagaagattaatattttcttatctctgttattgcagcagattgagtcattgtatcataagtcaataatccttccgtactaattttgatgcttctccggttttatttttagaatcccatagcctcttttaccaaagacatttcacgatgggaagtcagtttctccaataaaagaagggctactcccgaagcggtttgaggaccataggacgtgattatattgtcgtccaccactatcggttcatggacgattattgctccgaaactttgaagaaccttttgcttgactgcccctccgagatgataagtagtcgcctttctatctttcagcacaccacttttaccgacaggcaaagcacctacacaaactgttgcaatccatttcttccgggcatcaaactgacgaatcagatttaaaagcttctcttcataagcctcttcataaaagccgaaaacttcaaaacctccggggatggcaagagcatcatattcatcaacggatatctcatcaatcgtcttatccaccaaaacgggaatattaaaagaactgatgactttctcgttaaaaccacctgttaccacctcaacatcacagccaaaatcagttttcgcccatcccatcacatcaatgaaaccactaaattcaatcgtctcaaagcctttagcaagaaaaaccagtaacttcataatcgtcagtgttataaattaaacaaaccgtttatactgcaaagataggcagatacctcatgaaacaagaataatccgccaaaaactgctatatttacttcatctttcacacataaaaagacttctgcaaatacagtgtaaggataaaattcacaagatagttagcaagaatagacaagcagatctgacagacggcagctatctttgcgattaaaaaccgtctgacatgaatatacaagaaaaaagtaaaatagaatatcgttccaggatcaatcgggtgatggactacattgacatacatctcgaccagcctctggaactgaaaagtatagcagaaatagctaacttttcgccttttcatttccacaggatattcacgttcctgataggtgaaacaccgattgattacatccaacgcctccggattgagaaggcagcctgccggttacgggaaaatatggatatttctatcagtgagattgctgatagttgcggtttttgcacagtatccctttttagccgtgtattcaaaaagttttttggtttgacgccaagccagttccgtaaaacggagagacccgtttatgcccaggacggaatcttatttagcaagaacggacaaatggttagcaagaatttgacacccaagcatgtattatctccccaactttgcagcgtcaaatttaaaatatcatattttatggaaacaaaaatcgaagtaaaagagatgccggacatgaaagctgtttattgccggcatatgggagcattcaaagagattgtaaaagcgtatgagaaacttatcaaatgggcagaacctcgtggcctgtatattccgaatgttacgaaatcggcaaccgtcacacatgatgatccttcggtaacggaattgagtaaagtgcgccagagtgcctgtatcatcgtggaaggagacgtaaaaggagaaggtgaaatcggtaatctcgtcattcccggtgggcaatatgctgtcggacactttgaattgggtactgaagatttcgagaaggcatggaacacaatgtgcaagtggtttacggaaagtgggtatcagcaaggagatggatgtacttatgagttataccataacagtcaccggacacatccggagaataaacacattgtggatatttgtattccgataaaacctctttagaggatcatctgtcttaccggataaaaaacgaagaggatgtgtcaagactccccttttaacgaaatcatcttcgccacagatagttgtagcgaagatgattctttatttatgaagggtttcgacacatcctctttgatttgttctgaatggcagccccatcggaacgatatgcccgtcagatttacttcgcagtttgaaataacagactattgccattggtatccatccattccgccatcaagcgataatacgccggatattcagtcggagttatcaattgttttttcagtttcaaggtacggaatatctctattttatcctccgcctttttcactgtaacttctatgatgccgacagcattttcaatctttttgttagtcggcacaaccactggttttattcttgcatcaatctttacgatataggtataagcctcatcgggcaaataccgcaaaagcaggttaacgggacgagttgtattcagagccgtcacacgtccatcataacttgcccatccaccacgagcctgcggtaagtcgaatttccgataaccatcagccaatgcccttccggttttatcgctcacccgcaaggtgtcagttcgtgaaacaacatgagaaaccttctctaaaattatcggctgagcattcagatcaactacagaaacaaaatcctgtatatcggcaattcctttatcaaagagaaacaatctgctgacagcggcaagtccggctgcatctttatcttctgttttaggaaaagccgcttttatctccgcacggatgcctatcgcttgttgcaaggcagccaacaaagcagccttctccgcttcagttccgtatgccgaacggatcacttcggaagccggacgcaaaaggtatccggtttgcgacagggtcagacggcaatttcctaatccttctacataagcagtgagtaactcctttttttgttctgtggtttgtgcaccggcagtcagcttctgtgccaattcggtaacatcctttccattactttccagttgttgttttatcactttcagtgcatcagcctttgaagcataagtggacgccacaacagcctgtacattacctgccggcaaagagacgtcaagtgaataaggacgcggttgcacatttttcagtgtccaggtcactgttttcatgccatccgcagttttcaccaccggagcagcttttccattcaaccattcataatgcagaggtttgctttcgggcactgacagcgaaaacacatattccctgattggggaaagctcttccacctgctcgcacacatccagttcgggcagatatcccggacgggtaacgacggagtagtccagataaatggtagctcccaattccagtcccgtatgaacgactaccatctctttcagaccattataagccggagcatctgccgctacggaaggaagtacctcaaggagcgcattttcgggagtcttcacaatagtaccgtctttctgacgagtataagaatcgtgtatcttcagtgtctgaaactccggattgtaaatgataaaactctctccatacacacggttcatcgctgcatgagtaaacaaagtcagctctttttgcacacgcatttcctgactgccgtcagcgtgtaacgtataagccttgctcaatttcccaaattcagcttcggatgccgctttcaccggaaatgccagaatcaacatcgccagcgtaactatataataatatgtatttttcattctgctctactttttaatcaccaaatattcaccatacgccttgtgggcattcacagcattgcggaaactttcccaatcagaagcctcataaacacgcttcttcaaagccaatcgattgtggagcaacactttatttcctttctgtaccaacgaaccttcaaaatcggctcccactccttgcatggtttcatccttgaccgcactcaccagcttgtatcctgccggaagctgaaccgtttcatccagttcgaccaaacgggaacaagcatctttgaaaccatacttgcggttttctaccgaagtatcgatccacatataagaacgtacctgattataaaggttattcatcaccatcggacggaaaaacatctcgccctctcctttcaaggcataatcgggtatttcataacgaaaagtgattttaataggtgcagcctgatagtctttgggattttttccatagtctacgctcaacaatctggctttgggagagatggccaacagctgacgttccatcgtgcttttccattcgctctgaaagccggtggtaaagatgcgacggatattgctgtcactctgtccttcggctgtaagggtaaaagtaccgcgtagtgtaccatctgcttccaagcggttgtcggctttgatacgtacataatggttttcgggagccgaaaccggagtgatacacaaatcagaaccttcgggtacacccggcagatagttctgctgctgttcggcactgctccataactcgcggcagaaaggaacccatgtcggatcaagaggcatatatgttccattgctcagtttcaccactgccacacaatgattaaaatggtcggcaggaatactttctacccgactgcctgccatcgtcatggcaggataggcttcgaaaccagccatgcgcaagaacgaaatcagtgtacctgctatatctttgcagactccgcaacgatcagtataattcattttagtattatgaagtgtaaatccttctccttttcccatcgagatgccggaatagcggatgttatctgccacccaatgagtcaacacagctattttttccatttcggtcttcttgccttttatcagttcatccacttttttctgcgcttcgggcaatggatcaaaactaccataatcttcattcactttattgaaccacaacgacttgtctttccactggggagtggaagacatcatcagtttgggagctgcatcgaaaaggtctaccatgtttgtctctttaacgaaaggcatcatatcatccatcgcaaagctatatttcttgcgaccgtcttcataacgcatggatgatgcgcactcaccctgatagaactgaaactgaagttccttctccatcggaatgcttactacataaactttacgtacagtaggagtgctgctccaaaaaggaacaatatcataaaactgtccgcgcataggcggaataaagcgtgattcatcttcattaccggctgcaagcaacgcataggtaaagcctttcttggctatttcgtaatccacaatatcacccggctgcaaggcgcccacttcaatcatgatttgtcttgcgccccaataaatagcacgcgcaggagcagcataatcacaggttttcctgacatcaagttcatctacttttccattggcacgatggatggttacacgtttaaattcggcataagcagtcaaagggtcataatcgtatttaatcacccgattatccactgctcccctcggagtctgtacctttatcactttgcatacaacaaacgacccttgtcctgtaggctgaacagataccgatgtactatccaacagtgtcacacaatcggatgcttcgtaagtcttccccttcgcagcctgttcataaggtttccagctttgagccaatgacgcagccgaaacaagaaggcagcagaggagtgatactaatagttgttttctcatgtttttcacttacattttatttatagaaacaaatgtaagtaaaatctttggaatttatttacttcatgctaaagcaattatcttttttcctgcctcaatacaacaaattactacatcaccttacttacaaaaacaaatgacctatttgaaatatttaaattcataaacttaagttcatcaacacctctatatttgcattttttattactaatacatattaaacgcatagcattttccattacatttataacaaaaagcctaccataactcataataaaacgaataatatgcatagtaaaaatgatttcaacattgaaaattacataaaagctctatccacatacataccagcgtcctccatggtcaaactaaaaaaagcatataaagccttcacttttacaaaacaccctaaatcaactattcttgaaaacagacaactgaatgattcattttgcatccttatatgtgggaccataagacattacacaatagatagtaacacagcagaagaacaaacattacgattcaccctctcaggcaatttactgtgtcaatatggaaccgctacagaagcaacagaatatttaagctgcctatctgaatgtaccattttatctgtctcaaatacaattttagcagagataggagaagaaacaaatttgagaatatactgtcaaaatattataaaagaaaacttagagttagaagtggctctattaagaatgccaccagaaaagcgatatataaaactatgcaaacaatatcaaaacatatttctgacggtcccattaaaatacattgcgtcatttttaggaatcactccccaagctttatgcagaattagaaagcgtttactaataacaccctaataccactgaatattactttgcgtctgacttctctgctcatatttcaagtcttgaagaatacttgcattagcacgaatcgtaacattatagtatttccaacgtccaaatggtgaaagactggcagacaagttaaagcagtgcaaatcacgagaaatcgtacaggaagtctgcgttatttccttcgcttggaaatcgtaacccgaattgaacgaaagcgaccagttattggaaatcttcacattaccattcatattgatattgtgagtataagtaaacggatatctcatcgaatagcgattaataggcttagtcctatcttcacgaatattaaatgaataactgaaacttaaagaccaaggcatcttgaatacttgataaccatccgggtcggcttgcgccttctctactttcttggtcgtagttccatcttccgtaccttcagaatcttctccgtctccatcttctgactccttcttgtctttatccttctcgtcttccttcggaccgaaccactttttccaggtatcgttattaaaggtatagttaaaagaagaaccatacccctgaaaacgtccgaaacgtccatacgaccattcagttcgattaccttcgaccacattaccacttttatcaaacgtataagcgtaagtagcaaatgatgcattcatattgaaagtataattctttgtcagtttcagtcgaagattcatactcaaggggctccatggcttttcctttgcagccatattatatgacatattcacactcaaatcatcaatcaagctgactttctttaatgtatccttcttagcatcataatatttcatctccagattattagcaatcgagaaactaaccgttcccgaaccctcacgtgaagggactccaaaaggctgtcccgtatagggtgaataatactgagtatttccgttattatccgtatactcttcccagtatttactaaatgcaggagcaccactgataccaacctgcggagtgacaacgtggcgaatctgtatctctttcttcttcatgaaaagaggtttgtacataccatacagtttagtacttaaagacaaactggctgaatagttggaaacacgataaaagccattaatagtatcattcagattctgttccaaacgccctgtttcctcattatacgtctgatttatcttgcgggtgtaccaacgctccgtataattcaccgaaggattgacctgcaaatacttgaacagtgtaaaagtagcactgacaggaatattatggttcatcgcattttcccatccgctgatgccggtcttgaacagacggtcgtctttagtacggatactgttcgtcagacgtcctgtatagctgacagaaatcttctcataccaacgctcggctccggcagccttcttccgcttgaagggaaacagacggctcaatgtaatattaaggtcaggaagcgttactgcaatggatgagtcacgcatggtctgcgcaatattggtcgttccagacaaggtcagaccgatatcggggaaactacgggagtaactgatacttgatgtctttgtattctgagtcaacaactgggagttataaaggttgttgatgttagatcgttcgtaactactggtagagaagttcacactggcggagaaagtactgttcggacttgccttggcatcctgacggtggttccacactaccttgaagtctttggcaaccgtataatccggcattcctttgtctccggtcttggtcacctgataatccgcctgcaatgtaccggagtatttgtacctcttattataattggtcaatccggaaagccgccatgaacctttcgtgaatatatctcctgtcagcttcaagtccatgatgtcactcatagcaaagtaatatccgccttccgccagaccgaaaccacggcttgaatcatccatatacgtcggcataatgaaacccgaagaatagctgctggagaaagggaagaagaaaaacggcacagccagcggcaggggaacatcttccaccacaagataggcaggtcctgtcactacattcttcttggggcgcactttggctcttgtcaactgcatatagaagtgaggatggtcatgatgatcacaagtcgtgtagcgaccgtgctccataaagatttcatcatttgctcctttcttggctctgctaccggtcacataaccttcaccctgttgagtgataatatcggtgattcccgcttttttgctcttgaagttatagctgattgtttctgtatcgtatgcagtttcaccttctttaaagacaggtttacctttgatcgttcccgtcgtgtctttaataccataggcgtgtactgtactactgtccagattcatggaaatcacttccgctgccagctcaatgttctgatagttgactttgccgctaccataaagcgtagcggcacctcccaatgtaaaagtggtggagtcgttagattcataaataaccggtgcatcgaacggttgtttctttgtcggtgctacagagtcaacgcgtaccacaactgtatccgcccctaacgaatctttcctgttaagggaatccgtttgtgcagtgttggaggcaatcatccctcttcttcgacgctgagacgtagcctcatcaggaagcatcagcaagacaatcagcaatatgaatgatataattatttttgctctcaatggcgccattaactaatagttttacgcttgaagtggcaaaagtacacaatcttcatcaataatgcgtgagaatctccgttatttaattattttttagtgctataaaaacaaagagcaccacccatcaaagcggtttagaccttcttcaccatattttgcaatgcttttccgggctttttctactgtcttttcttcgtcaagatgagttttagaaaagaatttatcggcaaaacagattatttgctcttccagagtgacgggcaccatctcacgatgaggaacaggaagctggcgttctatgatttcttccagtgtcagtccggctccggtgtgacgttcgcaaaccagtgcatggcgttcaaaaccttcttttcgtaaaaggtctgcacccagatagccgtgcgcgatgtagggatgctctccgaaacattggatggtgggagcatcggtcataaagattcctatatcgtgcagaagcgcggcttctctgacaaagctgcggttgataggtaagttaggatgtgcatctacaatcttcaaagctttttgggctacagaaaggctatgtattagtagaatgtgtcgttgttccgtatcctgcggataaaatttgtcgatgatttctattggattcatactttttcactagttattacttgttcccttactgataaatgatatttttgtgcaatattacaaaaatttactgatatgcaagccagaagttccctcattcttttctctctgttcataatactgtgttctacatacgccagtggaaaagtaattacgggtgccgagcgtatggatcaatacctgccgttaatcaaaggaaagcgggtaggaatggtggtaaaccacacttccatcgtcggcacagagccaattcatctgctggatactttattaaaacaaaaaatcgatatagtgaaagtctttgcaccggaacacggtttccgcggcaacgcggatgccggtgaaacagtaaaagacggaaaagacagccgtacgggagtaaccatcgtctcgctctacggagataataaaaaaccgactgccgcccaactgaaagatatcgatgtaatcttgttcgacatccaggatgtgggcgcacgtttctatacatatatcagtacgatgtattatgtaatggaagcttgtgcggaaaacaaaaaagagatgattatactggaccgccccaatccatgcgattacgtagagggacctgtattaaaagccggatataaaagttttgtcggaatgctgcctttgccggttcttcacggttgtactatcggagagctggcgcagatgatcaatggagaaggatggatgactacccaggcaaagacttgtccgctgactgtgattcccgtaaaagggtggaaacacggacagccctatgcacttcccgtgaaaccgtctcccaacttgcccaatgcacaatccatccgcctttatgcctcactttgcccttttgaagcaacacgtgtcagtgtgggacgcggaacgacctttccttttcaggtgttaggcacacctaacaaaaagtatggcgattttgccttcactccgcgctccctgccgggattcgacaaaaatccgatgcacaaaggagtcacttgttatggcgaagatttacggaacgtaacagacgtaaacggtttcacgctccgttactttctgcgtttctaccgtttatccggcgaaggcgcagcattcttctcccgtccccgatggtttgacttactgatgggaacggattcggtacgcaaagcgatccttaaaggagaatcggaagaggaaatccgtgacagctggcaaaaggagttgcagacctaccgtgatatgagacagaagtatttactttactaaggaacggttcctccacttctcagcattccgttcgaactcttcggctttctttccactcaaccttgcaggcatttcaagtatctccggaatgtcttttgcattgtcaatgatttgagtgccggaagcgttcttcacaatacggacatcatcgtacagtgagtcattctccagataagcttgcatccggagcgtgtctcccgtcacgtcgatatgctggtagaaacggcggtccgtcccgaaacgatcatacttatcattgaaagatagacggtaactcttcggggaagcgtggcttaccagatacaacggggtggtcatttcgccctcatcgttcttattagtcatacgggcatagttatgctcatgtccctgaagcaccaagtctactccatattcacggaacagtccgtcgaacatccagcgtacggcaaggttgttcgttttaccttttatagaatatacaggatgatggagcatgacgatcttccatttctttttcgaagccttcagcgttttctccagccattcccgttgagagaagaggaaccaaggatcacggttactatccagcgtgatgatagtggcatcgttgtaatcaatagaatatacattattattcttatacctcgattcgagcagataagaaaagacataagcaaatcgtttctccaaaacacgtaccagtccttttacatattcatgatttcccggagaaaccaatatcggtttggtgggagctatggaatccacgctctgataggcttcatcccagtaacagttcatcggacgctctgcaaagtcaccggcaaacatatagaagtccgcctgcggatagcgatggcgcacattttccataaagccacgtgtctttccacgcaaagtatcctgcacgtcacctataaatacaaaggagaaatgatcagtcgaatcgggttgcatcgtgaacgaataccaatcggatgagcgatcgtcattccatacccgataagagtaggaatcgccataagagagttctttaaattttgcccagttggcataaccgaacccgcccagtgtacggagaaatttggaagagccgtcaacgagaagagtatctccggaaccgatctttgtatattccagctttgcctgcttggaaacgcctccgcacacccagctcacattacgggacagttcgccgtcatttccgaatgtcagaaatacccgttgcgggtcttccgtcagcacatagcgtatttcagggatattgtggaaccagactttccagcgtatcttacaaatgacaccaccggcaatcaatatcaggagaacgatgccccaagctattttcttcttcgtaatcttcatttttccgattttaaaaactggtagcaaagataaatatagtgtcccataaatcggaaattatgtccttttttaacctttaacaaattcacctctacatgagaatttaaatatctaaaattgctgtcatctgtcaccaaaagctaaataacacactgattataagctaataaagaggtgacagcagggcgtgacagcattgtgacagcacattttgttgtcacaatgccgtcacgctttgctgtcatatcctgctactatcatatattgctccttggaatgataaatcaaagaatagcttagtctagttggtttccatgcgatgaaactatagttccaaagcattgaaaccaatagtttcaagccgcagaaactttagttccaagctgaagaaaccaaagtttcaagcagaggaaactccagtttcaagacgatgaaactaaagtttcatcaagcaaaaaacaatttctacaataggaaactgatgtgtactggttttagttgacaacttcgtttgttataactgaattagtttactcaatatactttaatatctaaataggtttacttttgttattcgtggatgaagtccgcaaagagattattaattaaattattaaccattcttggatttaacttagaagttcaaccaagagttcaaccatagattctataaggaaatctgttattaaagataactattataagcgattatagctcagttggttgcctgcgaagccgaaggctttgaaggctttagagagcactagcttcccaagctaagggtcacgagttcgagtctcgcttaccgctccactgaaaaaacaggtagtcagacaatgactatctgtttttatatttttacaagagttcttttaactcattttcttgatattttatgtatcagataaataccataaaatcccagtaaagcagaaatgaatattaggaatagtagtccaataacaataaatttcttcatctgagtgaaatccatagatatactcttccatgacaccaagtaaagtgactataatagtaactataaatggataaatcagtcacataaggcgatataaagaaaataatgcgagaagaatagggcagttcgttcctttttcgtatttttgcaccctgttttaacatccaagaaaacttaaatagaaaaatataatggcaaaagaactgaaagacctcaccaaacgtagcgaaaactactcacagtggtacaacgatttggtggtaaaagctgatttggcagaacagtctgccgtacgcggatgtatggtgattaagccttacggatacgcaatttgggaaaagatgcaacgtcaactagacgatatgttcaaggaaacaggacacgtgaatgcttatttcccattattaattccaaaatcattcctgagccgcgaagcagaacacgtagaaggtttcgctaaagaatgtgccgtagtgactcattaccgtttgaaaaatgcagaagacggctccggcgtagtagtagaccctgctgccaaattggaagaggaactgattattcgccctacatcagaaacaatcatctggaatacatataaaaactggattcagtcttatcgtgacctgcctattctttgtaatcagtgggcaaacgttttccgttgggaaatgcgtacccgtcttttcctgcgtactgccgaattcctgtggcaggaaggacacaccgctcatgccacacgcgaagaagcagaggaagaagcgatcagaatgctgaatgtatacggcgaatttgctgagaaatacatggctgttccggtagtgaaaggtgtaaaatccgctaacgaacgttttgccggtgcacttgatacctataccatcgaagctatgatgcaggatggaaaagcattgcaaagcggtacatctcatttccttggacagaactttgccaaggcatttgatgttcagtttgtgaataaggaaaataagatggaatatgtatgggcaacttcatggggtgtttctacccgtttgatgggtgctctgattatgactcattccgatgataacggtctggtattacctccacatctggctccgattcaggtagtaatcgttcctatctataagaacgacgagcaactgaaacaaatcgacgcgaaagtggaaggcattgttgccaaactgaaagcactgggcatttctgtgaaatatgacaatgcggacaacaaacgtccgggcttcaaattcgcagattatgaattgaaaggtgtccctgttcgtctggtgatgggaggacgtgacctcgaaaacaatacaatggaagtaatgcgccgcgatacactggaaaaagaaactgtgacttgcgatggcatcgaaacatatgttcagaaactgctcgaagaaattcaagcaaatatctacaaaaaagcattggattaccgcaattctaaaatcacgacagtagatacttacgaagaatttaaagagaaaatcgaagaaggcggctttatcctagctcattgggacggaacaaccgagactgaagaaaagattaaagaggatacaaaagcaacgattcgttgtatcccattcgattcgtacgttgaaggtgataaagaaccgggaaaatgtatggtaacgggcaaaccttctgcctgccgcgtcgtttttgcacgttcttattaaaaatatctatttcaatagtaaaagagtcagatttttaaaattgagaatctgactctttttttatccatttcagttttatttcagaaatatctcttttctttgtagacagtaataaagaaaggagaagattttatgaagatattaattgtagaagatgaaccctctttaagagaattgatccaacgttcgctggaaaaagaacgttatgtcgtagaaacggccggagacttcaacagtgcattatacaaaatagaagattacgactatgattgtgtcttactggatattatgctgccggacgggagcggtcttgaccttctcgaacgtttgaaagctctccacaaacgggaaaatgtgattattatctctgccaaagattcgctggaagacaaagtactgggactggaattaggagctgacgattatttgccgaaaccatttcatctggcagaattaaatgcacggatcaaaagtgtgatccgtcggaatcaacatgatggagaaatctatatccgtcagggaaatgtaaagatagaacccgataaataccgggtgtttgtcaacgaacaggagctggaactgaacagaaaagaatatgatatcctgctttatttcataaatcgtcccggccgtctggtcaataaaaacacactggcagaatcggtatggggagaccacatcgatcaagtggataactttgacttcatttatgcacaaatcaaaaatcttcgcaaaaaattgaaggatgcaaaagcaaatattgaaatcaaggccgtttatggattcggctataaactgattgtagaataatcgaaaccagaaaggatcatccatgaaacttatatattatatcatttttcgcatcaccctcgccctgactcttatcctgactgtctgggcagtctttttctatgttacgatgattgacgaagtcaacgatgaagtggatgattcactggaagactattcggaaacaatcattatccgcgcattggcaggagaggagcttccctccaaaaataatggttccaataatcaatattatctgaaagaaataaccaaagaatatgcaaagagccgggaagatatccaatataaagactccatggtatacattgtagaaaaagaggaaacagaaccggcacgtattctgaccactatctttaaagatgacgaagaccgttattacgaattgaccgtatccactcccagcatcgaaaaagatgatttgaaaagtgcgattcaagtctggattattttcctgtatgtagctctgttactttgtatcatcatcatatccgtatgggtattttatcgtaatatgcgaccgctgtatatactacttcattggttggacagctatcagaccggaaagaaaaacaaacctctgaaaaacgatacacggatcacggaattccgcaaactgaatgatgcggccacccgttacgtagagcggacagaacaaatgttcgaacagcagaagcagttcattggaaacgcctcacatgaaattcagacaccgcttgccatctgccgcaatcggttggaaatgctgatggaagacgattctttgtccgagaaacagcttgaagagttgatgaaaacccatcagacactgaaatatatcaccaaactaaacaaatccctgttgctgctatcaaaaatagataacggccagttcaccgacaccaaagaggtagacttaaacgtactcctcaggcaatacctggaagactataaagaagtctacagctacaagaacatagaagtaagtataacagaacaggctaatttccatataaccatgaacgaatctctggctattgctttactaacaaacctgttaaagaacgcgtttgtacataacgtagacgaaggacatatccggattatcataaccaaacatagcatcaccttccgaaattccggagagaagcaaccactggatgagactcacatctttgaacgtttctatcaaggacacaaaaaagaaggatctactggattaggactggcaataaccgattccatctgccgtctgcaacagttgaacttgcgatattacttcgaacaaggagaacattgtttcgaaatctccaacaagaactagaagtaaaacaattaataaaacatctgccatccagagcaagacaatgtgctggatggcagaattaatagggtactacctaagattacaccttatgacaatacctgatttggactccgcatatatgattatcgggatcggatttcccttctcataaacataatatatgagattgcaaaacagataacagtcgctgcaatcagccccgtgagctgtggccaaacaacaagcagactctgtcccaacggcagcggactcggaatagccccttgtacctgttccatcgtaagcggtccgatacttctgacggaaggcatcagcagcgttgtagtagcttcattaaacaattcactgggtgccagacgcattaatccaagaataaatttctgataactgataatctgataaggagacgccatctgcgacggacttaatccctttgccactaaattgacaatcatcgtatagaatacgctgaaaaacagccaaacggctacggaagccagcgcagaagtagcagcctgacggaaacggagtgagaataagatggccaggttcaaccaaaaggctacataaaagatactcgttataagaaagaaaacgattctccagaattcttcagccgtaggaggaatgccaatggcaatcaatccgaatcccatcaccaaaaagcccagtacaaacagcataatacctatcacgatcaaagcagccacaaacttcgcattaatgatacaatcacgatgaatgggctgagacagcatacggctcaatgtccccttattctgctccgaattgacagcatcgaatcctaaagcaattcccaacaaaggacctaaaaagttaataaacagcacaaaagaggggagagtcccgtccgaagctgtaaataacttcaagaagaggaacgaactgtccggatcatccggtttgatagccgcaccgatattagtaagcgccgtgtatagcgatcccatacaagtaagtgctatgataccgatcagaataagaaaacgccagcttttgacatgatcggatatttccttatgtacgataacccaaaaaggatgattgactttactcatgcccttcgcctccttcctcaaaataatggttataaatatcagacaattcctgtttcttttctttcagctctgccatatcaatcagagcaagtattttgccgttactgaacaatcctactctgtcacatactttctgtgcctggtccagatggtgggaagaaaacaaaaccgtcagcccttcctctttgctcagccagcgaatcagttcaataaactcctgaacacccgcagggtcaattcccgaagtcggctcatctagaataatgatttcgggattcttaataagcacatcggccagaccaagacgttgtctcataccgcgggaatactttccggttttctttttcagctgatcttcaagccctacgcgcttcatcagctccagtgcttttactttcgcctccttgtcagggataccgttcagccgtgccgtatacatcagattttccagacctgtcatgtcatcatagaatcccacatcttcgggcagatagccgattttccttttcacttcaataggatgagtggtagaattaattccacaaatctcgacaattcccgatgtgggctccgttaatcccatcatcatcaaaatagtagttgactttccggcaccgttcggacccagcaaaccgaagatttctcctttccggatactcaggcgaatatgatctacagcagtaaatttaccgtattgtttggttaattcggtaagtacgatcacttgttcgcccataatttacctccttccatatttacggaacagatagtagacaacaccgatagtagccagaataatcagaacacctacccatccccaaatcatcggagtctttacggcaattctgaattgcgcatctgcattcacttccggagttttggccatcatcgtagttacataatcacccggaagcgctttcttagatgctttcaagatggctacaacagtagccgtttctccggctttcagcatttctatctttgacggttcgaaagctacatcccagtcaaccggcttgttggcagacagttggatatctttcaataaagaagaacctgtatttttaatttccagttcgattcgtttggtatcaccggcagtcacgtcagaacttaataatcctctcggggtggtcagttccatctgataagaaccggtgacaactacttccagttccagttcagccgaagtattgcctgtagcggcacgtacgggaattttataactgccagcttccacattggcaggaggagtgatgtctatacttacattctggctgctgttggcttctacttgtgcggaagttgcctgcttataattaggtttgaaaataacattccagcctctgggtgctttagccatcaacgcatacagttgctgatcggcagtctgattctttagtgtggcattaaaggtgaaagttgatttggaatttccctgcatattgggctggtcggtggtaaactccgtctgataagtaccttgttgtgccacaacgacattcagagggagttgcgcttctccggcagacactacaaaatgatagctgcctctgcttacttttaaaggaacatctacctttagattaaaagttttcttttctttagggagtacggccaactgactgagattccaaccaccggatttcatttcatgtttccagctgcttgataggccactgacggaaagattggcattcaccaacttgtctgtgttgttaatcaggtcgatgctgtagtcaatagacgcccccggtgaaacggagatttttgtgtaaggtgtgtacaagatcacgcttttaggtatagaatcgttagcgtgtgtgttactcatgggaagtattcccagcaaaacagttaataataaaaaacaatttgttctcatagtcatacgaaagttcttatggttgatttaatatgaatattgtcaaatttgtgcctgcaaaaataagcgatgaatttattagttgctgttaaaagaaacaaaagaatacaataagaattcgtaccctgtatgaagctgtgtgactttcattcttgaaaagtcacagggtctatagcgcagtgtatctaatcatttgaaaattttctaaataactaaaattaatatcttaacaaaaaaacttattatggaaactactaaaaagtctcagattgtaggtataaagaatgccggtatcgtaatcatctgctgtttcattgtagcagtgtgtatttttcagttcctgttgggaaatccgtctaactttatgaacaatgaccctaacaaccatccattgaacatgttgggtaccatttacaaaggtggtgtgattgtgcctgttattcagacactgttgttaactgtactcgctttgagtattgaacgcttttttgctcttcgttctgctttcggtaaaggctcgttggctaaatttgtagctaacatcaaagaagctctggctgccggtgaccttaagaaagcacaagagatttgtgacaaacaacgcggttctgttgccaatgtagttactgctactttgcgcaagtatgaagaaatggaaaagaacactgctttgcctaaagaacaaaagctgctggctatccagaaagaactggaagaagcaactgctctggaaatgcctatgatgcagcagaatcttccgattatcgctacaattactactttaggtacattgatgggattgctcggtactgtaatcggtatgatccgttcatttgccgcattgtccgccggtggtggtgccgactctatggctttgtcacaaggtatctctgaagccttgatcaatacggctttcggtatcttgacaggtgcgctggctgttatttcttacaactacttcactaacaaaattgacaaattgacttacggactcgacgaagtcggattctctatcgtgcagacttttgcagctactcattaatttggcgaaccctttaaaatctattaatcatgggtagagcgaaaattaaaaagaaagatacgttcatagatatgaccgctatgagtgacgtaactgtattgcttctgactttctttatgttgacatcaacatttgtgaagaaggagccggtgcaggttaccactccagcctccgtatcggaaatcaagattccggagacagatgtactccagattctggttgaccaggaaggaaaaatatttatgagtctcgacaagcagcaggatatgcaggctgtcttggagagtatgggtgaagagtatggcatcaagttcactccggaacaggcaaagaggttcacagtggcttctacgtttggagtgcctatcagaagtatgcagaaattccttgacctcccggaagatcaacgggacaaaattctgaagaatgaaggaattccttgtgatagtaccgataatcagttcaagtcgtgggtgcgtaatgcacgtgccgccaatgctgatctgcgaattgctattaaagcggacgcttcaactccatactcagtgataaagaacgtaatgaactcacttcaggatttgcgggaaaatcggtataatctgattacttctctcaaagcagaatctgaaaattaaaagggaggaaagacaatgagtgctgaagtacaagagagcagcggaaaaagaggaaaaggcaagcagaagaaaatgactgtccgggtagactttaccccgatggtggatatgaacatgttgctgattactttctttatgctttgtaccacgctgagcaagcctcagacgatggaaataagcatgccgagcaatgacaaggatataactgaacaacaaaagagtatggtgaaagcctctcaggcaattacattattgctgggagccgataacaagctctattactatgagggagagcctaactacaaggattacacctcattgaaagagactagttacggggcaagcgggttacgtgccgtacttcttcagaaaaatgctgcagctgtcaatcaggtaagagctttgaaacaacagaagctcgatctgaagataacagatgacgaatacaaaaagaaggtttccgaaataaaaagcggaaaaaatacgccgaccgtcattatcaaggcgacggatgatgcttcttatatgaatctgattgatgcattggacgagatgcagatatgtaatataggtaaatatgtgataacggatattgccgaagctgatgagttcctgattaagaattatgatgctaagggagaactgtcacagaacttggccgataaatgatgtaacacctaaaaaaagaaagtaaaatggcaaaattagatttagcttcttcggaatggtgtcagctgatttttgaaggcaagaatcaagcgtacggcgcatatagaatgcgtgccaattcacccagacggcatactattgcaatgctgattgtggtggcgatagcaatcgttggatttactatccctacgctgcttaagttggcgaccccggagcaaaaggaagtaatgacagaggttacaactttgtcgaaattggcagaaccggaaatcaaacaggaagagatgaaacgggtagaaccggttgcacctccccctcctgcactgaagagttctattaagtttactgcccctgtcatcaagaaagatgaagaggtgcacgaagacgatgagatcaagagtcaggaagaattgacttctaccaaagtggcaatctccattgccgacgtaaaaggtaatgacgaagccaacggagccgatattgctgacctgaagcaagtggtgacacaggctgcggaaccggaaaaagtatttgatatggtagagcagatgccgaccttccccggtggacagcaggaactgatgtcataccttgggaaaaatatcaagtatccgacaattgcacaggagaatggaacacaaggtcgcgttattatccagtttgtggtagagcgtgacggtactatcaccgatgtgcacgtagctcgtggtgtagacccatacttagataaagaagccgtgcgtgtggtacaaagtatgccgaaatggattcctggtaaacaaaatggtaaagcggtacgtgtgaaattcaccgttccggtaatgtttagattacagtaagatgatgaagagacaattttggctggtaggaatcgttttgttggcggtgttgagtgcttgccgttccaaatcggatggaccgacggatacgtattcgtctggggtgatatctattgcggcggatgaaagttttgagcctattatacaggaagagatagatgtgtttgaaagtctgtatcctttggccggaattgtccctcgctacacgacggaagtcgaggctattaatttacttctgaaagacagtgtccggttggctattgcaacccggacattgactgaggaagaaatgaattcctttcacagccgcaagttctttccccgcgagattaagcttgctacagatggtctggcattaatcgtcaaccgggacaatccggattctttgttgaccgtacgggatttcagccgcatcctcactggtgaggcgaaagactggaaggatataaatccgaactcccgcctgaagagtattcaggtggtgttcgataataaaaactccagcaccgtacgctatacaatggattctatctgtggtggaaaaccactggctactgacaatgtcagtgccttgaagaccaatcagcaggtgataaagtatgtagcagagaatcccggagcaatgggagtcattggtgtgaactggctgggcaaccgcagcgacaccaccaacctttctttcaccgaggaaatcagagtaatggcagtgagtgcggaggatgtagctactcctgctaacagttataagccttatcaggcttacttgtattacggtaactatccattggcacgacccatttacgcattactgaatgatcctcgcagtgcgctgccttggggatttgcttcttttatgacatccgacaaagggcagcggattatattaaaatctggacttgttccggctactcagccagtgcgtattgtccatgtgaaagacgaataataactaaaattagagactatcatgaaaagagtacaaatgtttttagctggagcgtttatagcagttgggtcgctctatgcgcaatcatctgatgccgaatggcaggcaggagttgcaaaattgaaagaaaccattcagacgaatccggctcaggccaatgaggaagctgaacagttgataaaaggaaagaataaaaagaatgtggaacttctggtggctatcggcgaggtatatctgaaagccggaaaacttccggaagcacaggagtatgctgctcttgccaaaaaggtgaatggcaaatcggctcttgcctccgtactggagggagacatcgcctttgagcagaaaaacgccggtctggcatctcagaaatatgaagaagctatctatttcgatccgagttgcacagaagcatatctgagatatgcggatatttataaatcagccaatgctgctctggccattgaaaaactggaacagctgaaagcccaggaaccgtccaacacagccgtagataagaaacttgccgaaatctattatttgaagaatgattttagtaaagctgccgaagcttattcgcgttttgcgatgggaccgacagcgacagaagaggatttagtgaaatatgcatttgccctcttcctgaaccatgacttcgagaagtcacttgaagtggcgaatatgggattgaaaaagaatgcgcgtcacgcggcgttcaatcgcctggcaatgtataattatacagacctgaagcgctttgatgaagcaataaaagcggcggatgctttttttaccgaatcggacaaggctgattattcatatcttgactatatgtattacgggcatttgctcgaagctctgaagaaatatgatgaagctgtaggacaatatgagaaagccatacaattagatccgacaaagacggacttatacaaaaatatctcttctgcctatgaacagaagaatgattataaaaaagcaattagtgcttaccagaaatattatacatcccttgataaagaacatcagactccggatttacaattccagtttggcagactttattatggtgcaggtacgcagactgattcgctgacaatcaatgctgaagagcgcaagcaggctttgatggccgctgattctgttttccattccatcgcagaagcagcaccggacagctacctgggtaatttttggagggcacgtgccaattccgcactggaccccgaaacgactcttggactggcgaagcctttctatgaggaggtagccaccctgctggaaagcaagaatgatcctcattacaattcagctttgattgagtgctacagttatcttggatattactacttattggctattgaaaatccggcactgaaagcggaagcaatggcgaataaagaaaaatctaaggagtattggagcaaaattctggctatagactccactaatgctactgctaaaagggcattggatggcatcaaatagtgaataattttagttgtttgtcgtgacaggaggagtggagagtgatcttagctcctccttttttttattgtcacgtttagctgtttttcagtctgttacattcctttggtaagcgtaaagcagtcgatgtccggtgcccagttgtagctgttacccatacggatatgattgtaaccggctttcagatcaacggggattgttacttgattgtgcttgtcatcctctcccagtgaatcgattttggttacgatgccgttgacatctacctccagttgtcttcctttgccgaatgaataatgaaccgtcatttggtaacgtccgccgtctgcgctgtatacttccggccattctgcgtaattctccggttgtccgcccaagaaacctactttcatttttccggaagcttcctgatcggcagcatatatgatgcctttcggatttttgccgagatcattgaacattggcaggtatgcccattctgcttcatacaatgtcggttccagacgtgtttctccttccatgcggaggaacatagcgctgtgtgcaggaagcgtttgctcaaagacatcagagaaatttcccaaatcactgcgttttgccaagtcacgtacttttacgttcccgccaaattccagtgccgagaaaggtacggagaagctacaaacggtgtccgatggattgtaaagagcaacggcacgtacatttccacgtttttgttcgatgtcttttaccagtacatagccttcgttttcatgttgtgctacgtatgcctgcaagcctagcgggtcttggttcagagcgattaattctttgtttgtcagcagttcaagagaagattccggcagactttccagattacatccgatcagcaggggtgagctcatgatacaccataagccgaagtgagcttcttcttctgtcggggtaagtccttttcctcctactttgctgttgtcgcggaaaccgatgaccatcatatccatgtcattgtaatgtccgtctttggcgtaggcagacaagtataggtttttgccgaccacatatttcaatgaaccccaatgcgcattgatgtcaccactgatacgccatgaagtagctacatcctttgcccatgtgccgggaaaagcccaacggcagatgttgacagagacgtccttgtttactttgtcgatgctgttccggatggaagtatagcgttcctgttcattcaggcccagtacatctccgccgcaatagtctatcttgataaagtcgaatccccaatcgctgaaatagagttgggcgtcttgttgctcatgtccgtaaataccggcacctactcctgcatgatcgttgtcccagatagaaccgcaagtgttgttgcccgcatctgtataaataccggctttcattccaagactatgtatatggtcggcaaccggtttcattccattcgggaaacggtttttgttggtctgcatttttccattgccatctcgttcgccgaagaaaccatcatcaatattaatataatgatatcctgcgtctttcagaccttttttaaccatcaggtcggcctgatttttaataatatcttcactgatatctactcggaaggcattccatgaactccaacccataatagggggattgactgctttttcacttccggattgagaaacctgagtttctgtacaactaacacataacaaggaaactaccgctgtggctaaaaggtggaatctgtttttcatgatgtaacaggttgatgaattaatgggattaaataaaatattggtaacaaagatataaatgaatctattggcgtgcaaataaattaaactgaaaatagactttataccccaacttattctctctatatttgttattatgtcagaaaactcaatatatttgtatcaactagttaacctaagtaatataaatctcatctatttacggcaatgaaaaaggaaatcaaattcagtctcgtttatcgggatatgtggcagtcgtccggcaagtatcaaccgcgtgccgatcagttagtaagaattgctccgttaattatcgaaatgggttgtttctcccgtgtagaaaccaacggaggcgcgttcgaacaagtcaacctactgtatggcgagaacccgaacaaagccgtccgggctttcacgaaacctttccacgaagccagcatacaaactcatatgctcgaccgtggtctgaatggtcttcgaatgtatcccgttccggcagatgtgcgtcggttaatgtataaagtgaaacatgcgcagggagtggatatcacccgtatcttttgcggcttgaatgaagtcagaaatattattccttccattcattatgccctcgaagcggggatgattccgcaggcaacgttatgtattacgttctcgcccgtgcataccgtagaatattataccgccatcgccgagcgtctgatagaagctggcgcaccggaaatctgtctgaaagatatggcaggtgtcggtcgccccgaaatgctgggacgtctgacgaaagcaatcaaggaacggcatcccgaaatcatcatccaatatcacggacatagcggaccggggctttcgatggcttctatcctcgaagtttgtgagaatggcgcggatattattgatgtcgcaatggagccgatttcgtgggggaaagttcatccggacgttatctctgtgcaggctatgctgaaagacgcgggatttcaggtaccggagattaatatgaaagcctacatgaaagcccgtgccatgacacaggagttcattgacgattttctgggttattttatggaccctaccaacaagcatatgtcttctttgctcttgaaatgcggacttcccggaggtatgatgggttctatgatggccgatctgaaaggagtacattccggcatcaatctgatattgagaggtaagaacgaaccggaactgagtatcgacgatttgctcgtgatgctgtttgacgaggtggaatatgtgtggccgaaactcggctatcctccattggtgactccgttcagccaatatgtgaagaatgtggcattgatgaatgtgatgtctctgatcaagggagaggagcgttggacgatgatcgacaaccatacctgggatatgattctgggtaagagtggtcgtttgcccggtgcacttgctccggagattatcgcactggcaaaagaaaaaggatacgaatttacggacgaagacccgcagaagaactatccggatcagctggacgagtatcgtaaggaaatgacagaaaacggctgggacttcggacaggatgatgaagaactcttcgaactggcaatgcacgaccgccaatatcgggattataaatcgggtattgccaagaaacgtttcgaagatgatttgcagcgtgccaaagatgccgcattggcaaaacagggattctccgaagaagaagtgaaacggatgaaacgtgccaaggccgaaccggtgacggcaatggagaaaggtcagatcatttgggagattgatgtggaatcgccttctatgccgcccgaagtgggacataaatatgacccggacgatgtgttctgctacattgctactccttggcatacatatgataaggtgttggcgaattttagcggtcgtgtgatcgaagtatgtgccaagcagggagcattggtagataaaggcgaaccattggcgtatatcgagaggtgtgaggaaccggcatagtctgtatcttaaataacggaaaaaagaaatccctttatccttgtcttgtttcttgatgaaatagactgtgataaagggattgctttatttctttttcttcttcctggtgtctttcttatcgaccgccttcttctctacaggcggaaacttaggaaccagattcattaatcgcaatatctgtttttgtcgtttcaataggtaagccgaaggcttcgcagagttaaaccgtatcgggttagggagcgtagcggcaatcagtgcgcactgtcctgagctcaacttggcagctgttgtgttgaatttatactttgcggtagcctgtgcgccataaatcccttttcccatttcgatagagttgagatatacctccataatccgttctttcgaccagaataactctatcagaaaggtgaaataaacttcgaaacctttgcgtacccaagacgattgcggccacaggaacacattcttggctgtctgctggctgatggtacttgctccgcgcttccgtttccgtttctcgttctccttcatcgctttctctatctcgatgaaatcgaatccgttgtgttcggcaaagcggttgtcttcggaggcgatgaccgccatcggcaggtgaggagatatcttatcaaaagaaacccacgtgtgtttccacgtgggtttatctcctgacgcaagctgctgtacacttcggatgaccatcagcggagtgacatacaccggcataaagcggtagacgatcacagccagaatggtagatgcaaagaagaaaatcagcaggttgcgcgcataacgcaatatttttttaattggaagcggcctgtgcatctttaatcatctgctcacttgcgtacatgtaaacttctacacgacgattctgttctcttccggcagctgtgtcgttgctggcgataggatcgctttcgcccattccctgcacacctttaatctgattggaagaaacgccgcagtttaacaggtagctggctacactctgtgcacgttcctgtgacaagttcagattcttctgacggctttgttcggcggtactgtttctccagccctgattgtcggtatatccgtagatggatacgtccatgtctctgttctggttgagtacgttgttggcgaacttgctcaatgcagacttggcagcagcactcagagtcgcattaccggtagtgaaaagaatacctgaatcgaatgtaacttttactgcctgcaatccgttgttgtcagttatctgctctacttgtgcgccttcaatttgttttgcttctgctgccgctttatccatcttctttccgataagggcacctgttcctgcacctactgcagtaccgatagccgcaccgatggcagcacccttgcctttaccgataacaccgccgaggatagcacccaatgcagcacccgaaccaccgccgattgcggcacctttgcccgtattgttcatgcttgcgcagccactgaatatcatggttatactcatgaagagaaccatccatttcatcttgttcataatgcaatgttttttaaataggtttataaaataatactttaataaattaacaacgcaaagatacatattatttgccaaggtcatactttttaggttaaaataactccggatgatctttgtatatgtaaaataacaaacgacacggctaccttgttgacacggaaggcagatttaagcattttttcctgatcatggtgaaccatcccaggagaatcagccctttggcaatcgttgtgacgcatactgcccaccagataccttctactcccatgcccatccgtacaaacaggatggcaagcggaatacgcatatagttgcatacgatgctgacaatggcaggaggcacggtacgcccgatgccgtagaacactccctgcattgtgatttcgagcatcataaacagctgcgaatatccgtcgatacgcagaaatacacctccggcttcgtaagccgcctgttcggggacaaagatcgaaaagacctcattgccgtaaaagacaaacagcagcgtgcagaaagtcccgaagattcccgtcatccatagggtggtgtgccaggctttcagtacccgttctattcgtccggcggcgaagttctgggcaataaaggcgctgagtgcggtggagaaaccttgggaggtattccaggtgatggcttctatctgtccgccggtggtgaaagtcatcagtccgatgtgtccgccctgttcggatgcggtacggcagaggaacatattgacgaaggcgaacagtgtgtttagggtagctacgggcaggcctagtttcagaatacgccgcgtgtactttttcttcagtcgggagaagaaggggaaaccaccgagcagggcgtctttgcggaaacgcagctggtagatgaagatggcgaaaaccgttgcctgcgagagccatgtagcgtaggcggcaccgtttgttcccagaccgaagccgaagataaacagagggtcgagaatgatattcataatcagtcccgtcccactgatatagaatggaattttgcttcgtcccgctgcattatagatacctgtgaaggcagcggacaggaatatgaacggcaatgcggtggaaataatccgcaggtattcgatggcattggctgtgatgtgctcttctagttcatagatgcggataatggggcttgcgaacatgaacagcagtccgccccagcagatcgaaatgatcagagcaatcgtgatattgtgtgaagcgaactggcgtgcatcttcctgattctgcgcgccgatggattgacctacgctgacttcggaccctaccttatttaataaggagatagaaccggacatccacgtcaggattcctaccgaaccgatggcggcgactgcctcactgcccagtcgtcccacccatgccatatctgtaaggctgtatgccatctgtataaacgacgttgccatgataggcatcgccagattgaaaagttggcggttgatagggccgtgtgtcagattcttaattccttgcatatcattttttctatttaaaaggaggcgcaaagatacataaaattactatcttcgcacatcaaatattcattaatcaaagtatacagatactatgaaacagaaattctcttctctttttgtattgctggtcctgctattgacaggactgcaagtctcggcacaaagtacgccaaaaccatttgatattgaacagccttctcttcgtgttttcctgccggcaccggaactggcgacaggtcgtgctgtggtagcctgtccgggtgggggatactccggcttggcggtcaatcacgaagggtatgactgggcgccgtatttcaacaaacaaggaattgcattgattgttctcaaataccggatgccgaaaggcgaccgcaccctcccgatctccgacgccgaagcagccatgaaaatggtacgtgacagcgctgacgtatggaatctgaatccgaatgatattggtatcatggggtcttctgccggaggccatctagcttcgaccatcgctacacatgcgcctgaagcacttcgtcccaacttccagattctcttctatccggtgatcacgatggacaaatctttcactcacatgggctctcatgacaatctgttgggcaaggacgcttctgccgatctggaaaaagaattctccaacgagaagcaagtgaccaaagagactccccgtgctttcattgtttatagcgatgatgacaaggtagttcctcctgccaacggagtcaactattatctggctttaaataagaaaggtgttccttccgttctccatatttatcctacaggcggacacggttggggaatccgtgaagatttcctctacaagagtgaaatgcagaacgaactgacttcttggttgcgtagtttcaaggctcctcgcaaagatgccgtccgtgtggcttgcatcggcaacagtattacgttcggagcaggaataagaaatcgcagccgcgacagctatccttccgtactggcccgtatgctgggcgacagctactgggtgaaaaacttcggagtgagcgcccgtaccatgctgaacaaaggagatcatccttatatgaacgaacctgcttataagaatgcgttagcttttaatcctaatatcgtcgttatcaaacttggtacaaacgacagcaaatcattcaactggaaatacaaagcagacttcatgaaagatgcgcagaccatgatcgacgctttcaaaggtcttccttcacagccgaagatttatctctgctatccttccaaagcttatctgacaggtgacggcatcaacgatgatattatctctaaagaaatcattccgatgatcaagaagctcgccaagaaaaacgacctgtctgttatagacctccatactgctatggacggaatgcccgaactctttccggaccgtattcatccgaacgaaaagggagcgcaggtaatggcaaaagctgtctatcaatctatctctactttaaaataaaaaatatgttaccgatcattgagcttttaaccggataattgtattaataatatagcccctgataaaagaaaggagaatattatgattagaacagttgctgtctttgtttttgtgtcttttgcttgtgttgctactgccttttctcaaactatagaaaaggagaataaaatagatgtgcaaaagaaaaatagctccgcggaagtgagcggacggcagttgcccgaagcaaaaaacatagaaccgaagttaccggatatagaggctaaaaagctcgcaacagatgataagtccatgcagacatacggtctgacaccttcaagtcctgcatcgggcttatctccctattcttacgattttccggcattgctggaaagtaatccgacattgacggatttttataattttcgtcagcattctatgaatggacaactttcctttattgggagtgcagaacaaaagacttatctgggattggggcaatatgtagcggtaaatgccggaatacgctggattccttctcaaagatttttcgttgaagcgggaggggacttgagtcggcaattctatttggctttgcctatagcgaggcaagatatagcgggaatatatacgagaatgcgttattctttagtcagaaatgtccggttaaatgtctggggacaatattttatggggggaaatacacctcctccggcttataatccgttatttccacatacaggggtaggagcctctatctcggtcgatgtgaaaaagaatacggaagtaagtgtcggtgcggaataccagtacgacaaaaaatcaagagaatggaaaatggaaacgtcaggccgcgtatccattggcttttgacacatatttcatcattcatttggctctgttatttatttctcatatctttgacgcattaaaattataatgtttcattaaaactagtggatgtttaactcatcatttattacatcggatttggtctgataagaatctgttcactttaacagattcgaacttccatactttcggataatctttccggaagtgattttcctatattatatagtagctatacacttctgaagagtaggtatgtctatatacaaacttacccaaggatacgttaatgttcgtaaacttgggtaagattttatagatattgtttggagaggacttagaattcacactcttatttatgaatccctacagggtctcaactttgttgcatcagttttctcagcttctctgccacttgtagtaactgccctttatggtctaccatggagatggccggaatagctccgggaggcaagttctttttgatctcctcattcttctttatcaattcttcgcaggctttatcacaccactgagcagctttctcacgcaatgacatatctgcacattccttattgagccagttcacccattgcaataaatgcccttcgtcacccaaaatggtgtgcgaagcaagtatcttatcgccacgtttcacaaatgaatcccattgcttcattataccgtctctgctgaggcgcagactctcgcctatcatgtcagcttccgccacattcatctgtttcatcttcgccacgtaggcatccagtccctgctcatcaaatgtacagtgattggactcgtccactttcaggtaggcatatgaaccggctatccagtcttcgagcagtctgcggtcgagagaagcggcctgacggggaaatttatcagtaatttctttcttatggtttaccgcatactgaaatgcggaagagttgacatcatgcacatagtaatagaataccaagaagtaatcttcatcttccagcattttctgctcacttccctgcaagaaatcagctgccacctttcctgcctcctgttcacggttggcagcagaaagcgcattgatatatccgcagataaaagccaaatcacggtcaccagcttcataacgtttcttaagtcccgaaagtccaccggactctacacccagtttcactttcttcagcaattcaggagcatcctcagcacctaccagtcggtatacgacctcaccgcttgaattaatgaaaagaagggtaggatatgcgtgtaccccatatttctttctgagttccactccttcacctttctccatgtccatcttcagattcacaaaatgacggttaaaataatcggcaaccaaggaatctttaaaaaccactttggataacctcttgcaaggaccgcaccaagtcgtgaagcagtcgacaaaaagaagtttgtcttccacctccgctctttttaaagcctccggaaaagaaagttcacgaaaagcaatcccatcagcttgcgcaagagtcatttgtgcgccggcggcaggtgttgcggagattttctgtgcaggaaccatttgttgtccttgtgtgttctggacggctaacaggcatactattgccatgaatgcccaaaaatgtcgtttcatttcaaattgttttaggttggttattagatttataataattgataaactcctcctgccaatacccgtacggctcccttcatttccagttcaaagagaattgcactcattttatgtacgggaatatctgtctctaccactaaggtattaatctgtaagtttccttgtttttccaacgtatgaactatcttttgctcctcttctgtcagttccagaaacaggctgcgctgtacattctctacctttgccggatgtgaatccaacgtccatcccatcgcctccaccaagtcttcggcagacaacagaagggatgctttactgtcacggatcagttggttacatccttttgaatattcatcggtcacacgaccggggaaggcgaaacagtcgcggtgatagctttccgcaagctcggctgtgatcagagagccgcctttggcagccgattctaccacaatcgtagcatcacacataccggccacaatacggttgcgactgataaaattgtgtttatccggtgttgtaccgacaggaaactctgtcagcaatccgcctttatcaagcatttcaacggctgtcttacgatgaagagaagggtaaatacggtccagtccgtgagctaacacgccgaccgtaggcaagtcattgtccaatgcactccggtgggcattgatatcaatgccgtaagcaaggccgctgacaactaatacgtcaggacacaaagcttttaagtcacggaggaaagtagtacagagttgtgtaccgtaatcagtagcgtggcgggtgcccaccatattaatgatatggagagcgttcaaatcggcatttcccttatagaacagtacaacaggagcgtcttcacactcccgcaagcgggaaggatacgcctcatcatgaaaagtcaggcactggatatgattcttttgcaggaatacaagttcctgttcggcacgggcaataattgacggacagtccagtgcacccgacacccgttcatgtactccggataatcgctgcgccagttctttcctgaagcggaacacatcggtggcactcttcatgccctctaccagacgtttcgctccaatgtgcccgataccgggcaccattgtcagagcgatgctatatatttgttcttgttcgttatcggtcatttcaggtatggagcaaagacattgtcgaacaattcgctgttacttaaacgtccgtttaccacacataccgtctcaacagtggatttcactactactttctgatcgcttttgcggaagatatcctgatagaatacgtatttgatgccttctttcttcatatacagtttggagacaaactcatccccactcttcaacggagtcttgaaagccatattgatacgtgccactaccggatcgactccctgttcatgcaacgccgcaaaactaacacctaccgaggtcagaaactcgtggcgggtatgctccagataatgctgataattggcattgttgacaatcccctgaaggtcacattcgtaatcacgcaccttcatctccaattcgtagatatactggctcatcgtttatcctcttttctgttctacatcaagtcccttgaatttcttcaattcttcggtagataccaatttatataatttgtcgctgggacgtatcttctctgatttcattgagaaacgctgacctttctttaccgtctctaccggcttcagatcgacacgcgcttcgtccagtgtcataaagactgcgccggtggtaggtcccgttatcagcagcttgtcacctacactgacttcggcagcttctaccaagaactcagagacaccgatattggagaagtatttgatacctttgcccacatagattttacgttccgtagcggccgaaccataattccgtgtccattcgcccaagcgttgtcccagatagtagccatcccaaaagccacggttaaagactgccttcagacgttcatcccaagcggcaatcttttcgtctgtaaacgtatcatccagataggcctttatcgcttctttataacattccaccaccgtacgcacatactcaggaccgcgggcacgtccctcaatcttgaatacacgcacacccgcatccatcatcttattcataaaatgaatggtcttcaagtctttcggtgacatgatatattcattgtcgatatccagttccacatccgtctccttatcgcgaaccgtataagaacgacggcatacctgcatacaggcaccccgattggccgagtgattcatttcgtgcagagacaaatagcacttaccggagactgccatgcacaaggcaccgtgacagaacatttcaatacgaatctgctctccgctcggaccgcagatattctcttcccgaatctgacgataaatctcggccacctgttccagattcaactcacgggccagcactacgacatcggcaaactgggcgtagaacttcaaggcttccgcattcgatatattcaattgagtagacaggtgtacttcctgaccgatctgacgggcatagttcattaccgctacatcggcagcgatcaccgctgatattcctgccgctttagccgcgtccacaatggtacgcatcaaaggaatatccttatcatagataatggtattaacggtcagatagcttttcattccatgttcatcacacgtctgagctatctcacgcaagtcatcaacggtaaacgtattggcagaacgggcacgcatgttaaggttttctataccaaaatagatagaatcggctccagcctgaatggctgccgcaagggattcacgcgaaccgacaggcgccattatttcaaaatcttttatattcattttactatctgataatcattaaaatgtgataggagaatgcaaaggtacgaattaatccgtatccgtgaaacttacctcaacaaatagttctttcagtttttatccgtacctttgcaccgcaaaaagaagtatcgattatgaaaataagccatatagacctgggagaacaccctatactactcgccccgatggaggacgtgacagatcctgctttccgcctaatgtgcaaaaagttcggagctgacatggtatatactgaatttgtatcgagcgatgcactgatacgcgctgtcagcaagactgcacagaaactgagtatcagcgatgaagaacgccctgtagccattcagatttatggtaaagatacggaaacgatggtcgaagctgcgaagatcgtagagcaggcgcagcccgatattctcgacataaacttcggctgccccgtgaagagagtagcaggaaaaggagcaggagcaggaatgctgcaaaatattccgaagatgctggaaattacccgtgccgtagtggacgcagtcaaaatacctgtgacagtgaaaacccgtttaggatgggacgccaacaataaaatcattgtagatctggcagaacaactacaggattgcggcattgccgcactaaccattcacggtagaacccgtgcgcagatgtacaccggagaagcggactggacactgatcggagaagtgaagaacaatcaaaggatgcacattcctatcattggcaacggagacgtgacaacacctcaacgctgcaaggagtgttttgaccgttacggagtagatgcagtcatgatcggtcgtgccagcttcggacgtccctggatattcaaggaagtaaagcattatctggaaacgggggaggaattgccgccactcagctttgaatggtgtatggaggtacttcgccaggaagtgattgacagtgtgaatctgcttgatgaacgcaggggcatcttgcacgtgcgccgccacttggctgccagtccgttgttcaaagggattcctaattttaaagagactcgtattgccatgttgcgggcagaaacgaaagaagaattgttccggatattcgaaacaattcctgaaaaagtaaattctcttttagattagttttacttaaacatcggctgcgcaaaccacttcttgaacatccacgtcgccacaacatacaacaagaatgcagagaagaaacctacgatcgcatcgataacgtagtgcgcctgaatatatactgtagccccgcaaagcagcatatagaaagggatcagacaggcaaacaacttcttactgccacgccatgccataatcataagaatggtagaaataccgacatgcgaactggggaaagctgccgtaggacgctctcccacttgctgcgaaccttctaccaaactgtaaaagaagccatgttgatagcccggaccgggaagtaactcctgattgttattgaaataatcgccgatggccgggaaaattcctttagatacattatcaaaacctatagctgggaagtagaactgcggccctgctaccggaacaaagatataaatcagataatagataaagaaagaagttaccagtacaaacgacatcttctcaaaccattcaaacttatagataaaataaaacaccgtcacaatgagcatcatcggataataaaagaaatatcccatattgaatgcttcactgaccaaaagatgcgggaatgtatgacagaaccagatagcaggttgcccattgaagataaactgctcggttatagcaaacacatggtcgagattcggaaagaaccggttaaactcaaacgtatccggataccagtaggaaagcaggctcatctgaatagcaacacgtacaaacgccgaaaacttgcaaggagccagccgataaagatacatcagcagaaaagtcattgcagcgatcatcgccctatccagcaacatgtgccatggatgatccattcgctgaaacaggaacagaatcaaaatggaggtcaacagattataaatcaatgttatcttctccacagcaaacaaccccttccgggtttccactcgcttaaataagtctaaagccatccttcgtttttataccagtcaatggtttcacggactcccttctccaagtcatattcgggagcataccctaactcattaatggcaggggttatatcacattgccagttacgttgtttcattattttatatttatcagaattcagcgtactgctcttgccggaacgtgttgcaatgaattcagcgagcaaagatataacttttagcacaattaatggacatttcacatgaataacaaacggattacccagttctttttgtattaagtccgaaaatacacgactattatacaccttcccgtcagtcagaaaataggctcttctagtcacttttttttctattcctaaaaagatggcctgcacaatgtcttttacataaacaaaagtcaggtcctgccgccggaagccgacagagaagtcaacatgctgccggatggacttcgccatcaggaaataatccagttcacgaggaccgtaaactcctgtagggcgataaataacataagggaaaccgggaatactctgaatataaagttcagccttaagcttgctaagaccataagcagtatttggcatcgggacatcaccggcttctatcggcgaataatctttttcgcgtacaggtccgaatacactcagcgtactgatatagatgaattgcttcggaaccatattcaacgctttcagggtatcaataaagtatttggtctggagataattcacataatcaaaagtattcttatccggacatttcgtgactcccgcacaatggatgatatagtcaaacttattataggttcctttatgtccggagagttgggcacgcaattcattgggatgagcaaagtccagttccagaaagtggatcttccggttcttcaagtactttttgctgctggtgggacgaatccccgcccacacaccaaactttcgttttaatgcctcttcgacaataaaacttcctataaatccgcttgctcctgttattaagatgctctccattaattataacctcaatgtataagaaaagaatgatgctacaaagatacaataaatataaaataaaagccattttgcatttctcaattattctctcttataaacattcctcctaaatcaccttagaaggaaattcgaacgatagaaatcgccaagaagttcaagctgataaggactaaaggtcatgtcactctttttcatcttttattcattttagttgatacttatagtagtcaaccaaatccagggtaagacagaaggcttcttatatcattaatcctcctttgtctccctattatatataggtgcattttgttttcagcaaggcttctttatgccaccgcctattgggtcggtgacattttttcggtgtttgccgtcactattgttattgccgtcactttaatcgtcactacttaaattattctatgacaatagtttattatataaagtgacgatgacgttaaaaaactgttttataatgtgacacgggaataagccggaagatcaatggagcagaagtctttatccagatacttgaagtatccggtaatggcaatcatggctgcattgtcggtcgtatagctgaatttaggaataaaaatattccagccatacttttcagcgtgttctcggaaagagttacgcaatccgttattggcagagactcctccggctacggctacttcttttattttatattctttggcagctttccgcagtttgtccatcagaatgtctacaacagttgcttccagagaggcggccaaatccactttatgatgctcgatgaaatcgggatcgtctttcatccagtcacgcaaggagtataggaaagaagttttcagtccgctgaaactgtagtccagccccggaatatgcggtttgctgaaagtatacgctttcggattgccttgacgtgccagtttgtcaatgatcggtccgcccggatatccgagacccatcactttagaacatttatcgattgcttctccggcagcgtcatcaatcgtctgaccgagaatttccatatcattataggcttttaccaatataatctgtgagtttcctccggataccaacaggcaaaggaacgggaatttcggttggatattttcttctccttctgctttaataaaatgagctaagacatgccctgtcagatgattaacatctatcaaaggaataccgagtgaacgtgcgaatcctttggcgaaagagacgcctacaagtaaagatcccatcaatcccggtccacgtgtgaaagctaccgcgctcagttcttctttggtaacccctgcccgtttcagtgcttcgtgtaccacaggaacgatattttgttgatgtgcccgtgaagctaattcgggtactactccgccgtatgcttcatgtacggcttgacttgataccacatttgacagcagataaccatccttgattacggctgccgacgtatcatcacaggaggattcaattcctaatattattgcactcatatgtttttaaactattaaacggtgcaaaagtaatgataaaactacgattcataacgaactattttatatttttgttcgctaaataaaagttatcgcttatcagaacgctgaaaaagactgtacgctgggtagttggtattgtactgggagtatatatcggaactattgttttgctgaatattccaaatgttcagcgagcaatgagtgtgtttatcgccaaggaattgtccgaggtgctgaatacacgcctgactatcggcaaaataaatatcggtctattaaaccgtattatcattgatgatgtgctgcttgacgaccagagcggcaaggaaatgctcaaagtaacccgcttatcggctaagtttgatatccttcctttctttaagggaaagatttccattagcagtgtccagttattcggctttaccatcaatctgaataaagagactcccgactctcctccgaattttaagttcgtattggatgcttttgcttccaaggacactgtaaaaaaggaaagttcgctggatttgcgtatcaattccgttttgattcgtcggggaaggatggcttatcatgtattgtcagaggaaaagactcccggaaagtttaatgccaagcatgtccagcttcagaatattatagccaatatttcattgaaggcgatgagcagggattctttgaatcttggtatcaagcgtctgagcttcgatgaaaaggcttccggattctctttaaagaagatgagtctgaaattggttgccaatgataaacggactaatatagagaattttgccattgagctgcccgaaacttcactgaagatggatactattcatttggtgtatgacagtctgaaggcttttgatcagttctcggagaaggtccacttttctttccgtacgttaccctcgcagattactctgaaagatatttccccttttgtacctatattggcgcatttcaaggaaccgataacgctggatatgcaggtaaaaggaacggtcgaccagcttacctgctctcatctggagattacggccgacgaccgccagttccggctatcgggggatgtatcgcttcaggaactatcgagtccgcaggatgcgtatgtgtacgggaagctttccgaactttccgccaacaatcgtggtgtcggttttttggtgcgtaatctgagcagcaattacaatggtgtacctccccttctggaacgtttgggggatattgatttccgtggagagatttccggatacttcaccgatctagttacttacggacagcttcgtaccgggcttggtaatgtaaaaaccgacttaaagttaagttccgataaggctaaggggctgtttgcttattccggtgctgtcaaaacagaagagtttgaactgggcaagttattgaataatgagaaatttggggaaatcacctttaatcttgatgtacatggacggcatatcgaaaaacagcttcctgctgtagagttgaagggattgatcgcatctgtggaatatagcagatataaatatgagaatattacgctggacggcgaatacaagcaaggcggatttaacggaaagatagcgctggatgatccgaatgggtctatttatctgaacggagatgtgaatgtgacatccaaggttcctactttcaatttccttgccgttgtcgacaagttccgtcctaatgatttaaatcttacacctgattaccaggatgcggagttctctctgaaggtaaaagctaattttaccggaggttccattgacgagatgattggagaaatcaatgtggacagtctggagttcagggcaccggacaaggaatatttcatgaagaacatgaatgtacgggctacccggcaggataatgaaaatcagcttaaactgacttctgaatttctgacggcaaacatagcgggaaaattccagtaccatactttaccggcaagtattttcaatatcatgcgtcggtatgtgccgtctttgatattgcctccgaagaaaccgatagagacgaacaataattttgcgtttgatgtacatatatataatacggacattttatctacgatatttgatgttccgttgactgtatatacacattctacgttgaaagggtattttaatgatgccttgcagcggctacgtgtggaaggctacttcccccgcctgcaatataaaaacaactttatcgagtcgggtatgatcttgtgcgagaatccttcggaccatatcagtgcgaaggtgcggctgaccagtctgaaaaagaatggagccgtgaatctttctctggaagcacaggccaaagaagataaagtcagcacgactctgaactggggaaataatgccatagcaacttatagcggaaagttggcggctgttgcacaattcctgcgtacagcaggtgaaaagcctttgctgaaagcgatggtggatgtgaaacagacagacgttatcttgaatgatacactttggcagatacatccttcgcaggtagtggtggactcgggcaaggtggatgtgaataatttctatttcagccatcatgaccgttatgtgcgtatcaatgggcggctttccgacaatccggcagataccgtaaaagtggacctgaaagacattaatatgggatacgtatttgatattgcaaacatatccgatgacgtaaactttgaaggagatgctacgggaacagcatatgccagcagcgtgttcaagaaacctgtgatgaatacccgcctcttcgtcaagaacttctcgctcaatcagggccgtttaggtgatttgaacgtatatggcgcctgggataatgagaaaagaggaatctatctggatgcttccattcaggatatatcaccgtcaccatcgcgagtcatcggtatgatctacccgttgaaaccggaaagcggactcgatctgaatatcgatgcccatgaactgaacttgaagttcctcgaattttatatgaaatcaatagcacaggatataaaaggacggggaacgggaaaagtacatttttacggaaagttcaagggattgaatctagatggggctgttatgacggatgcttccatgaagtttgatattctgaatacccactttgccgttagagatacgattcatttggctcctaccggattgaaattcaataatatgcatattgccgatatggaagggcattcgggaaccttgaacgggtatctgcgtttccagcatttcaagaatataaattaccgttttgagatacaggctaataatatgctcttgatgaatacgaaggaatcgacggatatgccattctttggaacggtatatgctacgggaaatgcgttgcttgcagggaatgcgatacagggactggacgtaaatctcgccatgacgaccaaccggaatacggtattcacctatatcaacggaaatgtggcgtcggctgccagcacccagtttataaagtttgtagataaaacgccccgtcgaaacattcaggattccattcgggtaaattcctattttgagcagatgcaacagaagcgtcaggcggacgaagaagagcatcagacagatattcgtttgaatattctagtagatgctacacccgatgccaccatgaaaattattatggaccctatagccggagactacatcagtgcgaagggaacaggaaacatacgcacggagttttataataaaggggatgtgaagatgtttggtaattaccggatcagtcagggaatatataagttcagtttgcaggaagtgattcgcaaggattttatcatcaaagatggaagtacgattactttcaacggcgctcctttggatgcgaatatggatattcaggcatcatacacggtaaactccgcttcactgaacgacttgaatccggatgtttcctccattgcccagcagactaatgtacgggtaaactgtatcatgaatctgagtgggattttactgcggccgaccattaagctgggtatcgagcttccgaatgaaagagatgaaattcagacgttggtgcgcaattatatcagtacggaagagcagatgaatatgcagattctttatctgctgggtatcggtaagttctatacggaagatgctgcacggaacaatcagaactcgaacgtgatgtcatcggtactctcttctactctgtccggtcagttgaataatgccttatctcaggtttttgagactaataactggaatatcggtaccaatctgagcacgggtgataaaggatggacggatatggaagtagaaggtatcctgtccggtcagttgctgaacaaccgcctgttggttaatggtaatttcggctatcgggacaatccgatggcgaataccaactttataggcgacttcgaagctgaatggctgatcaaccgctcgggagatattcgtctgaaggcttataatgaaacaaatgaccgttactacacaaagacaaaccttactacgcagggagtcggtatcatgtataagaaggatttcaataaatggagtgaccttttcttctggaataaatggaaactgcgcagcaagcggaaacgtgaagaagccgaaaaggtgcaacagcagcaaacagacagcattgccgatgataaagctaagtcggagctaaagagaaagcgagcacaggaataaaaataaatagtgacactataccataaccgatagtgtcactattttattttatttgagaatcgtaccgtctgcggttactttaatatctatatccggagaattatttccttccagttcaatctgataataggatgtttctgttgccatctcaaagtattcggcatcatccatctgatatcctgcatactcggtgctgatggcattggtcactgctgtgggcagttcgtttctccgtacctcccatgaggtagaataccactctctgcctttatcaaacaggacttctttggaaacgttgcggttcaggccactgtcgaaatggatgatatctacttccgtaaatccgaaatcccagtcgtttttatcatcttccacgtctacttccacgattcttgctcctgcatatttcccatcaatgaaagtcttcatgacggcgggcagttgagtggtcggaaggtgctcgttttcatgatcgtctgtgtctgcaatgcttttaatcagcactccgtcggcagaataatacagatcgacttcctgattttggttttccacctcaatgacgtagactgtttcgatgccttgccgctcgagtttatccacatcgtctcttttccatgtcttatagtcacttgcttcgaatgcactctttaccggatcgggcaatgcggtgtacgggatatccgtttcagtcatatgccagttgccatccgttgtgaaccatgcggatgcctcatatccatcatagaagtccgctacataatatcctgcctttgtttcccactttacgttcttgacgttaggatacctggtcgagaatgcttcttgcaatggggtaggaacagcaattgattcatcgtcatcgttgtcgcagctgtgcaggctccatgctgcacagaatgctatcagtagtgtataaattctgagtttcattgttgtcgtagattttaagaaagttaattatcaatatcaatcagattaaacttcaggtcaaatttcagttctgtacggttggatagctttacttcgtaatctttcttatcacgttctatcttcagcacttttgcatccggataattagttgttacatatttctgaatggcggcaggaataatggcaacaggtacggaggtgtgcttgcaatctacttcctcccagtttcccttcttgtcaaattccactttattaccattcgtgaaaatcacttcatagcttttgtaaaggaagtcactttccatttttgccagtgccactttgctgtcagagaaatgctgtttgatgaactgttgtgctaattgtggcatttgagtcacctggataggtttatcgtcatctgcacgtgctactgtctgtaaagtgaacaagcatactaataagaatactaactttttcataatcattgtttttttaattggttttactgttatcatttaatttataatgcaaagatgagaggagaatctgaaaagatttgggaattttgggcaaaatctgaaaaaaacaaaggaaatctttcttattgagctattataatgtattcgtgtaatgaagatgaaaagtatgatatattagaaagatacactcctgaaactataacatctgacgaaatagctcctgtgcttaatttacaggcacaatatatggatagtaatagcgaaatagtacttgtaacatggatgaatccggaagatgattttttgtctaaggtggaaatctcttgctgttctgcgaatgataatcttttgggtgaacctgtgttgttggacgctgtttctaccaaagtaggttcttatcagacgtcactttctgtggaagagaggggatatgtaaagattgtagctattaatgaaaaaggagtacgctcggaagcccgtacagcagagatcctttcttcccaacaggattttgtatatagagcagattgtttgatgtcttctgtgattgaattattttttggtgggagatataatgcatggaatgagaattaccccaatgctacaggtccctattgggatggcattgcagccgtttggggacaaggtgcagcttattccggatttgttacaatgtataaggtcacaaaggaaactaataatgagaaactaagagcaaaatatgcagaaaaggaagaaacttttctaaactcaatagacatttttttgaataatggtagtggacggaaatcttttgcttatggtacttatattgggccgaatgatgagcgttattacgatgataatgtctggattggcatcgaaatggccaatttatatgaacttacagggaatgaagtttatttgcagcatgcaaatactgtttggaactttattttggaagggatagatgacgtgactggcggtggagtatattggaaagaaggtgcggtatcaaagcatacatgttccactgccccggcagctgtaatggctctaaaattataccaattgagcaagaatgaatcatatttggaaatagcaaagagtttgtattcatactgtaaagatgtattacaagatccgaatgactatttattttatgacaatgttcgcttaagtgacccttccgataagaattcggagcttaaagtatctaaggataaattcacgtataattcgggacaaccaatgttagctgctgctatgttgtatcggattacaaaagaagaacaatttctgaaagatgcccaaaatatagcacagtcgatttataaaaaatggtttaaaaactatcattcgtctatacttgatagagatataatgatattaagcgatccaaacacttggtttaatgccgttatgttcaggggattcgtagagctatataaaatagataagaacgatgtttatgtcaaagcggtgaaaaataccatggaacatgcttggcaaagcaactgtagaaatcggttgactaatctaatgagcgacgattatgcaggtgataagaaagaaggtaagtggaatataaagacacaaggtgcttttgttgaaatcttctcacttattggggaattggaacaacttggatgttttcaggagtagttaaataaattagtagtaaaatttttgtaaggttgcttggtctctcaaagatagaattctatttgtggattaagcaccttgcaagaaaaaagaattatggagtataaattaaaagctttttgtattagtgcattgctgattttattgcaagtgaatgaaatatttgcagaaagtggctatgaattgtggttacgttatcacttaattgaagatgttgcgttaaaaagatattatcagataaaaaacagttcgattgttttcactgcaagaacgcaaaaacaattggtggcaaaaacagaactatataatggattgaaaggactacttggttttactatacaagaaacgcatgatgtaaaggataattgtttgttggtagggaacgtggagtcttctccgttaataacttcccttctttgtgcaaaagaacttgatagtttgggagatgaaggatatataatccgttcgttgcagattgagcaaaaaaaagtgacagttgtggttgcgcaaaaggatcaagggttgttgtatgcaatttttcattatttgaaattaattcaaacacatcaatcattagatggggtgtctgtcaaagaagttccccaaattaaatatagagtattgaatcattgggataacttagatggaacaattgaaagaggatatgcaggttattctttatgggattgggaacgtttgcctttctatcgaagtcaacgatgtgtagattatgcgagggcaaacgcttcaataggtattaatggtactgtattgaataatgtgaatgcaaatgcaaaaagtttgcgtacagagtggttgataaaagctgcagggttggctgattctttccgtccttatggcattcgggtatttcttactgcccgttttagtgctccacaggaaattggtaatttggatacatcagacccaatgaatcccaaagtgaagcagtggtggagaaataaagtaacagaaatttatgaatacattccggattttggtggttttttgataaaggcaaattcggaagggcaacctggaccgcaagattatggacgtactcacgctgaaggtgccaatatgatagccgaagcattgcaaccttatggtggtatactgttttggcgtgcttttgtttataaaaatgagcggtatgtcgaccgggttgttactggatataatgagtttaaacctcttgatggacaatttaaagaaaatgtgtttttgcagactaaaaatggaccaatagattttcagccacgagaaccatttcatccattgtttgggaaaatgcccaatacagctttatctcttgaatttcaaattacacaagaaaatctgggacatgcagggcatttagtatatttagcacctttatttgaggagacattgcaatcggatgtttatggggatggaaaaggaaatacagtatcgaagattcttcagaattatcatgaaacttgtggaatgtctgcaatagctggagtgtcaaatgtaggaactgatttaaattggacgggatatttgtttggacaggctaattggcatgcgtttggaagattggcttggaatccggatttgacaagcgaaaaagtgtcagaggaatgggtgcgtatgacattctctaatcgggaagatgtaatagattcgataaaaagaatgatgttgatttcacgggaggcagctgtgaattatatgatgcccttagggcttaatcatattatgaattttcatacacacaatggtccggagccatggcatgatgaccctttatggacggcttatgattatcaccaagtaacaaaagatagtataggggttgatcgaacagataaaggcagtagggctacaggccaatatcataaattggttggagcatattttgaaaatttaaaaacttgtccagatagatatttactttggtttcatcgtcttccttgggaatataagatgaaatcgggacagacattatggaatgagcttgttaatcattattataagggtgtagaagaggtcagaaccatgcagagtatttgggcctcattaaaggacgtaatagatggagaacgatttacgagcacggagaatttacttcagaaccaagagcgtgaggctgtttggtggagagatgcttgcttgctttttttcaaggagtactctcaaatgcctattcctgaggtgtatgaatcgtctcgttattctttagattattataagaagattccctttccgtatgattggaataaaacacaaatgtttaagtaatgataagtatgtatagagttttaattatttcagttgtgataggatgggctattaatataaaagcccagataaaagtggcttgtgttggtaatagtattacagaaaatatagctttatcaaatgaacaaaaatatccctccattttgcaagaccttttgggaaatggatatattgttcgcaattatggtattggagcacgtacagtgctgaaaaaaggagattatccatattggaatgaagagcgatataaagaagtgcttgcgtggaatcctgatattgtaattgtaaaaatgggaacaaatgatgcgaaagcgcagaattgggcttataaagataattttgaaagtgattatattgaatttatactttcttttcagactttgccaagtcatccgaaagtctttatttgttatcccattccaacgtttaaagataatttccttcctgtagaggatcagcttcttgtaaaagaaatgatgccaatgatagataatatatccaaggcaacttgtgctgacattatagatttacatacacctttggttggaaaggatgattgtgtgtatgacaaagtacatcctaatgagaaaggtacgaagattatggcgcgtgttattgcacgaaaaatatgtccgcatagaaagtttccttttcccccagaaaaaaagataaatgttgtatttgttggtaatagtattacagaagctacatacttgaaaattactccgcctgaatggacaactatttatttagatagtttggggtatgatgtacagtctgtaaattgtggaaaaagtggttatacaacttttgatttccttcctggtaaaggtggttttaaatatgtgataagaaaagccgatgagctatataagaaagataaaagaaatcttgtgttttctttttgtttgggagtaaatgatagcgcttgtaccggaaccaatggagcacctgtttcggctgaacaatatgaaagcaatatgcagttgattattgatagcttatgttttcgatttcccgaggcaaaagtggtgttgcattatcctatctggtatagccctaacacgtataatagtgctatgtatcttaaggagggattaaaacgtttgcaaacttattttgctgcgatagaaagacttggcagaaagaataagggtagggctatgatcggagacacaaaaggatttaaggtctttcgcaagcattataaaaaataccatacccctcaagaaggtaaacgaggagttttttatttacatccgaatgcggagggagcgagggtattaggtcggttatggagtgaaggtattaaacaataattttatttattaaattaaaaaaaatatgagaaaggttgtattgcaaattatctgttgcttgttggcattaaatgtgcaggctcaaaaaaatattgagttgttttcacctgatggaaacataaaattggcattaaacatatcagatgaaatatcttataccatttcctgtgaagatgtgatattattggagaacaaccggttacagttggaattaaataatgaagtcttgggggaacatccccatttgcaaggacagaagaagtggaatgtaaaagaaatgttgaatcctgttgttccattgaaattctcaacaatagagaatgagtattctcagttgctattggattttaaagggggatattctttggaatttagggcatttaatgatgggattgcttatcggtttattatgaagaaaagaggaaatatcgagatcatgaatgaagtcatgcaattgaattttccatcagaatgtcaacttcatctgcaacaaaccgggggatttaagaccgcttatgaagaaccttatttacatttgaagagtggggatgtgaggttggagagtacgatggcaactttaccattgctgcttagttacccccaaaaatattcgatattacttggtgagacagaggtgtttgattatccatgtatgtttgtaaagggaggtgaaaagaatagtgtacgagctgtttttccgaaagttcctatacagtttgaagaagacggggatagaagtatgaaaatattggaggaagcagcctatattgcaagaactacagggaaaagaggatttccatggcgttatttcgtaatagctaaagaggataaacaattggtggaaaatacgatgtcatgtagactatcatctggttgtagcttattagaaacctcatggattaaacctggacaagcgagttgggaatggtggaatgatgcagctccttatggacctgatgtgaattttgtttcgggttataatctggaaacctacaaatattatattgattttgcttcgaagtatggcattcgatatattattatggatgaaggatgggcgaaaagtacgcgcgacccgtatactccgaatgctaaagttgatgttcatgaattgattcgctatgctgaaaagaagaatgtgggaatagttctttggctaacatggttgactgtggaaaataatatggatttatttaagactttctcagaatggggagtaaaaggtgtaaaaatagattttatggacagaagcgatcaatggatgatgaatttttatgaacgtgtagcagcagaagctgctaaatataagttgtttgtagactttcatggttctgtgtctcctaaaggattagaatataaatatcctaatgtactttcgtatgaaggtgtaagaggtatggaacagatgggaggggccactccggataatagtatttttatgcctttcatgagaaatgcagtgggggcgatggactatactcctggtgctatgttaagtatgcagcccaatgtatattgtagtcaaagaccgaactctgcaagtataggaacacgtgcttatcaattagcattattcgttatttttgaaagtggacttcagatgttagccgacaatccgacattgtattatcgtaatgcggattgtactgaatttattacacgggtacctgttacatgggatgaaacgaaagtgttggatgctcgaattggtgaatatttaattgttgctaaacggaaaggagaaaagtggtttattggaggaatgactaataatcgtaactcagagcgtatatttgagattagtttggattttttaaacgaagacaggggctataaaatggttgcatttgaagatggaatcaatgctaatcgtcaagctatggattataaaagatatgaacgctctgtaaataaaaaagataaaatagtaatacgactagcgcgtaatggaggatttgctgcacttattgaataatttgattgtattattttatggatgatgaaaatagtcaacataatattcgcatatctaaaaaatacgttttttattggggatattcataattatgtaaagaaaatagttttcaaatacaagcataaattgatccctattcaagttccagctatgaattgggtatatctatattgaggatttccaaacaagttgtactatttctttgtatcatctcgaagggagagcgagggctttgatttatcggtttaatttttctatgagatttatggtataatggtttcgatagaaaagcagaaagctcgtcagttgttctagctgttctgttatgagggaatagtattgatggtattttattatacaagttaaatgactagaatgaaattcgtttgtgttttatataaaccaatactaggtagttcaagggtatttgtggtttattttggtttgatgttaagttactatctttaatagggtcgattctgttggactgattataatcgtttcacagcgatggttattatctcttcctcctcatatcccatatgattattgcccaacagggtttataaaaaaggggtttattaaaaaagggttatttttatgatcttaattatttattagttacttccacccttaccaccactatgagtaggattagtagtcactgtcttatactgatggtcagttccggtatagcgtgttgcagttactgaaatcttcacatccttattattatacttcactgtggtcgacaatgtagtagtacgagtcttggcatagcaagtataagtcattgttgtataaccgttcacatttacagtattataggtacgagttgtttctgtaatacctgatgccgatcccatcaatgagtataaacgagttttgaagaaagctaccatagcattaactgtttctggttttgcacctgacaaagctttttctacagccgctttaatatccgcatctttacattcccaacccgacttttctttataagtcaatgcaattcctgttacagctttaggattttcactgttatcacaacttgcctgtcctaaaatctcactcttcactacattttcagtactaactttactagtgactttattttccatagcataggaagagaaatgcttaactttagttgtgtagctacctgatttctcatcataaacaactttattaatgtcctctgtttgtggaacccactttccattctccaaataagtaagtaccatatcatcagcgaaagtcaagccaggaataggattaggaattgaaatagttggatagtggtcttttgcaaatgtcaaaccactaggttcaaagtgtgctgccgccaaaggtatggtcttttctacttctttattctcttcttctttcttcacttctgtagtcacagtttctggggctggtacatacgtagttacactgacttcagcattaccaccttccagaacgtcttcattaccttctgtctgaattgccccagctgggatttctaattcaggagttacaagaggaagatcttctttcacatcctccggttcaacagtacccggttctttaacttcctcattcgaagcactcttatcttctaccttaacctcttctgtattaccagtctctccaacttctacagtcgtaggttcactttgcttagtcaaagccacagcaacagtcaccacactacgattttccgcattagcagcaatttctacagaagtactttgagcaagataacctttaggagcaacttctacagaatacttacctacattcttctctgttacagagaacttaccatctttgtcagtcttaattgtctcagtaccaatttttacatcaacaccagacacacctttcccggcatccgtcacagtacccataatataatactcaacaaccggagcgggagtttcaatcacttcacctggttcttgctttggttcatcgtcatcatcatgacaggaaactgttacaaaagacaacacaccgaaggctatcgccaaagagcatgcatacaaccattttaaatttctcataattgttcaatttttgtttaaattactaatatcaactcttatttaagttttgtcttttcattggtacgaatcaaacaataacggatataatccggctgccagaaacggctgttttcagcagatttcggttcggttctatagcttacccccaaagcacggcgagcaaattcattcccactacgcatgtcatattgaaaagcgaaataatccggaagcatcacacgtaccgcgtgacgactacgcttcttacccggcaatggaatcgaaaaatgaaatccggcatttgtttctccatctgtatacatgccataaagtcccacgacatattcaccgaagtaacgtgaaagaattccgcataccccataatctccatatataaaacgtccaccgctaactttcaattgagtattcacttgtggaatgaaataacctacgctgagctgcccattcactcttttccatttactcattccccagtcgttgccatataaatgagacgaaccggttataccaccttctccttctactgtccaacggccgtcagaagaaaaataaccaataccggctgcgagtccctgacgatcatccgagaaatttccaccagtcaggtatcccttccaatgattatccagacgaaattcctgacgcaatgtcaaataccccagtcggatacaatcccatttgcccggctcattattgacgataggtaagcaaacctgcagcctcaatgaagcacctttccaaagttgcatttctacagccggttgcaattcaaaagctgctttatataatttgtaagtaacattattaactaacattacccccggataaaccactacgtccactttcccaaaagtagtagactctcgtttggttccttttaaggcctccattgcagttttggtggaagtagtcatctgcatactacagtaaactccatccaaatcacattttcccgattgataatcctcaatcagcttcgcaggcaaagtgatacaaagttgcggcaaagcattatccaatatgaccaactgcaatgtagagacttccggaagagtgatcaggcgacgtattgcaatgcctataccattataagatcccctatatacggaagtctcaaatgctgccgtaatcgtatcctgcttctgtgccacagatatattttccatttgcaattctttcaggacttcagatatcccagcagattgcgcgtccacactttccaaagtgcagcaacatattatatatagtatactaaatactcttttcatcttcttaatgtattaatgtacattcataacgcaaaccggcagaaacacaggtaaattcgcgcgtaaacacatggacggacaaacgtttccaaaaacgtattgctccacccaaattccatccattggtatcatactctgccatcagctttaactcacggcaaaaagcgggagtataacgaataccaccaaaagggcctttcttgaaagccggttgattgccctgatgaaaataccagcctgctgtaacagccaactgatgccccttgcagaaaccaaacgtcttagttaagacaccataataatctccccaatactgagtagccttttctgtaaaaagatcatcagcaccaattaccacagcagggaaataacggctttctttcaatggacggatacggatagtattggaacgatcttggttgtgataaccgactctgccattatacgttcgcattttgagtaacgtcatacggtaagtcagttcaacaaaagagaacaaagacatatctaccgagtagttcatggtaggatagttaaacttattaggcgtaacctcttcaggaagaaagtttgcgcttcccataaaggttcctgtttcctgcatctcggctgtaggtatcatcatctgcccagttgccccaagagcatattgtgcatgaacccggcttgttgtcaagatgagaatcagaattaatacaacaccctttaatggaataaatcgcatatcccccaaaatagcttcagtttgtttcattttttatctatgtatattcctaaatagagaccttaccccaatttgattcataaatcctctatttttaccattcttttttctgttacttcttaggtaacggaaaacacaggggaagggagaaatctcttaaaacacgaaaaataggacataccaagttgctaaaggaggctcagtctaagcgtagggtgaaattcctttgattatgggacgtaaaaatcttagaatatgaagaaaagggttctttcatgttctaggctatttttatcttatttttaaatcaaaaaagaaaaaaaggatagtttatttgcttgttatttatttttttgtctatctttgcgccattattatttccgttacctaagaagtaacacacacatatatatactgattactaatactttatattatttacacttttctccaagcaattcttcacgtaagataaattcattctatttacttcagtacgttctttcaaagcaaagcctttaagatagatttgtgttgttttgattgatttgtgtcccaacgattcgctgatcatttcaataggaactccgcgatatttcgcagtggtagcccacgaatggcgaatggtataagaagtgacaggagaagtcagatgcaaagcctttgccagtcctctcaaatggttattgaaattccggagggcagactggtattcccgataagcactttcatctttccgttttttattaccattcagaatactaaatagataatcagggcaatcttgcagagcaggttttctgttctgaagctgataaatcatatccttagcagtatccagtatttccacactcatcggagtcttcgttttaacacgattataatgaagaacattcctgtctaaagacgacttctccaaatgtgccaaatcagcgaaagacataccacagaattgaaacatcaaagcagcaatcgcctgtgtacgccgtaaaatatccgatttaggatctccatataaaagcttatgcaactcagttgccggcaaagctttcttttgacggacatccactcctgtatacaccccgtgaaacaaccggtgaacataaggagccctccccgattctactccacgattataaatactacgcagcatacgcatatacgtcgaaaccgtattaagcttcaagccacgttcataaagatactgcccgtaacaccgtaagtgttcgcgggttacttgtccgaatgacacggtaggtgtgccacaaaaccctctaaaagaaagaagtgcattttcatacacatgcgcagtagaatagcgcccctcttttcgtaaacgaccgatgtacatctcagcgcatcggctaaacccattttttttcatcatttatacactagttaattatataaatcatctcagatgagagaacaaatatacttcctcttagggttttaaccatcacaagaattattttatttcgaacgaaaatcagaaagcgaccctcactcacgtgaaagtcgctttctgattttcataacttaatgaacaaactaataaataattaaccttttcttaaaaatctcaaacattatatcttaaacggttgcatcttcaaatataccttatagtctttaatcatccccgttttaccggcttcagccctgggtagataagagaatcccgtaataactttatcttcaccaagatctatcacaatctgatgagggaatgcaggtttggaagaggaataattggtatgccagaatgttgattcctgcaaatcaaaaacatttgttgcaatattgttcgcggcatccgtttcctcactatcggcataaatcactttccaatgctgacgggataccggtttgccatcttcgcccaacaactccaattctgcaatagccgcgaaatctttcccatcatgggcgttcaaagcctccagacagaagaaacgagtctccaccttcttaccgaatttcacatgttgccaaccattgcctgacttaaatatcccttgataaacaggagtttcatttgttaagtccaagttctcacccatcttacgatgagcataagctccgttaccacgttgtacatccagaattggttgacgcagaccttcagtttcagcttttgaaggaccagccatatccaatataatgatttcattctctcctttcttcaaccagcagcccggtacatataaggtctgttgaggtccgatttcccaataacgaccaatcgcatggccattcacccataccatacctttactccagttcatcatattcaagaatgtatcccctaactcattgaggttaaacgtcgaccgataataagccggttgattttcagcattctcctgttgtttatactgcttatcacgggcaaaactataatctaccggaatagtatatacctgccagtccttcaccagttcaactcctttatcagattgcagttctactttctcggtaatacctttccagtcataaatacctttgccgaaattcattcttcccattgcttccaccaggatatccagtctgtcaccttctttcaatggtggtaactttactacaccttcccccttcaaacggctcagagtagccagtttcttaccattcagaaagacttgtgcccagtcatgagcttctgtgatcagtaatgtctgttctttatcagaagcggataatgaagtccgatacagaatactaccccatccctgatcaaaagcttccattgtccggatatcctcactctctttggggtgaggcagattatcaaataagactgccatttcagtcattttaatagtaggaatagctatagtcggtatcgaatccggaatttccggcaaggtttcaccttccggcaggtagttaccaagcagattccgtacttccagatatttaggagtcaccttaccggattcattgataggagcatcataatcatacgatgtgcaagtcggtgaaaagttcgggaaattcgcgcctccccaatgcccgaaactagtccccccgtgagtcatatacaagctgaaagaaatattgcggtccagcatttctttcataccttttaccaattcttcggcacttcttgtttcatgcttggctccccaatggtcaaaccatccggaccaaaattcactgcacatcaatggagtgtccggccgtagttctttcaaccgtttaaattgctcgtcgatgttagcacccgtaccgaaattaatagtccagagcaaatcatccagtgcattattctcaaaattcgagttccagtcacactggaataaaggaacacctgtaaaaccggcttgttttaccatgtcacggatttcggatatatacggcttatcgattccaaatgctccatactcattctccacctgtaccataatgatattccctcctttactaatctgaagatcagccagctgtttgcccacttcgttcaaaaagagtttcacacgttccatgtagtatgggtcttgctcgcgaagtttgatatccttcttcttcagcagccaccaaggcaagccgcccatttcccattccgcacagacataaggtccgggacgcactatgacatacattccattctcttgagccaaacggcaaaacgcagctatatctttctgtccggcaaaatcataccttccttcttccggttcatgaaaattccagaacacatacaagcaaatcgtattcatacccagtgccttgcacattttaatacgatgttcccaatattctttcgggatacgcggataatgaatctctgccgcttttacaacaaacggttctccattcagcaagaaagtattcttccccacttcaaatgtgccctccgaagattgagagcatgagctgccaagaacagccactactaaaataagtaaatacaataaaggtttcttcattttctatctattgttttcatgatatatctcatacttaataaagagaattcactatcggctaatgtttccattaaaccgacagcgaatttgaaaataatccaagtgttcctaaaaactaaaataatacctattgaaaactgagtacggtgcaaagatgaggtaatatataataatgtatgcgatctgtcaaataatacattaaaaataagattgtccatctttataaaatgaaattctattttttgtgctttggatacgctctatctttgcaacatcaattaatcaatcttctagtggtatgaaaagttataataaaaagtttgtctattccatttgtttggtttctgcgatgggcggtctgctctttgggtatgactgggtggtaatcggaggagcgaaacctttctatgaactctatttcggtattgccgattcgccgacgatgcagggactggctatgagtgtagccttgcttggctgtctgatcggtgctatggtagccggtatgatggctgaccgctatggcaggaaacctctcttgctgatttccgcatttatctttttatcttccgcatacgctaccggtgcattttccgtattcagctggtttttggcagcacgctttttgggaggtatcggcatcggtatcgcttcggggctgtctccgatgtacattgccgaagtagctcctacttccatccgggggaaactggtatccctcaatcaactgactattgtattaggaatccttggcgcacaaatagccaactggctgatagccgagcctatacctgccgactttacgcctgccgatatctgtgcttcatggaacgggcagatgggatggcgctggatgttttggggagcagcatttccggcagcggtattcttgctgctagcctgttttattcccgaaagtccccgttggctggcaatgaaaggcaagagagagaaagcatggagtgtacttagccggataggaggaaaccgctatgcggagcaggaacttcagatggtggaacaaacttctgcttccaagtcggaaggaggattgaaattattgttcagtcgcccgttccgtaaggtactcgtactgggtgttatcgtggctgtgttccagcaatggtgcggtacgaatgtgattttcaattatgcacaggaaatattccagtcggcgggttattcgctgggtgatgtactctttaatattgtggtgaccggtgtagcgaatgtgatctttacgtttgtggctatctatacggtcgaacgtttggggcgccgtgctttgatgcttttgggggctggaggactggcaggtatttatctggttctcggcacgtgttacttttttcaggtcagcggtttctttatggtagtgctggtagtgttggcgatagcttgttatgccatgtctctggggcctatcacgtgggtactgcttgctgagatattccccaaccgcgtgcgtggtgtggctatggcaacctgtactttcgctttgtgggtcggtagtttcacgcttacctacacatttccgttgctgaatactgcattgggcagttacggcacattctggatttattcggctatctgcgtcttcggcttccttttcttcctgcgtgcattgcctgagacaaaagggaaatcgctggagacattggagaaagatctgataaaataaaaagatataattaataatatcatggtaaaagcatggagagaaaaggttgtaattcctacttatgaagtaggtaaaccggaaaagaatcctattttcctggagaaacgtgtctaccagggcagtagtggggtagtttatccttatcctgtcatcgaatcgatgtccgatgaaaaagtagataaggaatacgaagctatctttattgaaaacgaatacatcaaggtgatgattctgcccgagttaggcggtcgtgtacaaatggcttatgataagatcagggaacgtcattttatttattacaatcacgtgattaaacctgcattggtggggctggcaggtccgtggatttcgggaggtattgagtttaattggcctcagcatcatcgtcccagtacttatatgcctgtagatacgacgattgaagaaaatgctgacggcagcgtcactgtatgggtgaacgaaatggaacggatgtttcatcagaaagggatggcgggcttcacgcttcgtccgggacatgcttttctcgaaataaaaggggtgctctacaaccgtaccgaagtgccgcaaaccttcctgtggtgggcgaatcctgccgtagcggtgaacgactactatcagagtgtatttccgcccgacatcaatgcggtgttcgatcatggaaagcgtgccgtatccagcttccctatagcaacgggtacttattataggatggactattctgccggagtagacatttcgaactataagaatatcaaagttcctacttcgtatatggctgtcaactcccgttacaactttgagggtggctacgaaaacgacacttgtgcaggtatgcttcatgtggcaaatcatcatatttctccgggcaaaaagcaatggacatggggaaacggtgatttcggccgtgcatgggaccgtaatctgactgacgaggacggaccttacatcgaactgatggctggtgtctataccgagaaccaaccggactttacatggctgcaaccttacgaagaaaagagcttcgtacagtacttcctgccttaccgtgaactgggagtggtgaagaatgcaagcaaagatttgttgatgaacatagaaccggaaggtgaaaaggaggtacgtttcaagatattcgcaacatctaagcaggtggttaatgtagtgctgaaaggtgacgatggaaaagtgtattatagcaggcaagtgaccattactccggaagaactattgaatgaaacggtagacgtagcaggggagaagttgaacaaactgaatcttgaaatcaccgcaaacggcaaggaactgctttactggcatgccgaaccggacgaagtaaaaccgattccggatgctgccgaagctgctttgttaccggaagaaataaaaacaaccgagcaactctatctgacaggtttacacctggaacaatacagacacgccacctataatccggtagactattacgaagaagccttgcgccgtgacccgatcgatgtacgtagcaataatgcactcggattatggtatatccgtaaaggccgtttccgtaaagctgaacaatacttgcttacggcagtgaagaccttgcagaagcgcaacccgaacccgtgtgatggagagcctatctataatctcggacttgccttgaaatatcagggacgctataatgaggcttacgaccgtttctataaatcatgctggaatgcagcctggcaggatgccggttattttgcctgtgctcagattgctacgatgcaaggacgtctggaagacgctttggacgaagtggaccgttcgcttatccgcaactggcataatcataaggcacgtgctctgaaaacgaccattctccgtcagatggggaaagcggaagaagccttgcaagtgattgaagattcattggctattgataagttcaacttcggttgccgttatgagaagtacctgataaccaatgctgccgaagacctgcttactttaagggcgatgatgcgtggcgaagctcacaactatgatgaaatcgcacttgattattgtgctgccggttgctggacagaagccgcttctttgtggaatgtagctatcgctgagggcagtgtaacgccaatgacttattattacttgggttggtgtcttgttcagggtaagttatccggggcggaacaggcatttgccgatgctgccaacgcttgtccggactattgtttccctaaccgcctggaagccatccttgctttgcaatgtgctatggaacaaaacccgaatgatgcgaaagcaccttattatctgggtaatttgtactacgataaacgtcagtacgatttagcactcgaagcatgggaaacttccgccggactggatgacaagttcgctacgatatggcgtaatctggctttggctaactttaacaaaaaggatgaagaagcaacggccatcgaatatatggaacgtgctttccaactcgatacgaccgatgcacgtgtgttgatggaattggatcagctctataaacgtgtccgtcgtccgcattccgaacgtctggcgttcttgcagcaataccccgaattgatagcgcaacgtgacgacctcgtactggaagagatcactttgctgaatcagacaggcgagtatgaaaaggctaaaacgttacttgatgcgcatatcttccatccgtgggaaggcggcgaaggaaaagtaccgggacaatatcagtttgcccgtgtggaactggcgaagaaagcacttgaagccgggaattacagtgaagctgtctcgttgctggcagagtgtcttgaatatccgcatcacttgggtgaaggtaagttgcacggtgcacaggaaaatgatttctattatttcatgggttgcgcttatgaaggtctggggcagaatgacaaagcggtggaatgctgggaacaagcgattgtcggtcctaccgaaccggctgctgccatgtactacaatgatgcaaaaccggataaaattttctatcagggactggctttgttgaaactgaaccgcatggatgaggctaacggacgcttccataaactgacaacttacggagagaaatatctttttgacaaggttaaaatggattattttgcagtgtcactacccgatttgttaatatgggaagatgacctgaccatacgaaacgtcattcactgcaaatatatgatggcattgggttattggggattgaacgaaaaagagaaatccgttcggttgctgagtgaggtagaaagattggatatcaatcatcagggtattcaggcttttcgtagtctgattgggtaggaagtattggttcttggttaggaccggcgtactcttgtttcagtccggtgctaaccaagtacttcttcctgtttatggtacaaacttaatgcagacaggcttgtccacctttatatctttacgtatatccgtcagtaatcctgtatccgtatccctttcataaacctgtatcacattactatcccgacaagccaccagcaaatacttgccgttaggcgtgataatgaaattgcgcgggtgaatgcctgtcagttgataaccgactttcgtcagcataccgttttccggatggatactgaagatcgccagcccgtcagcctttagccggttacttgcatacaggaatttgccgtccgggctgatatgaatatcaccacttcctttggctcccacagtgtcggcagcaatagtctgaatttcttttaactctccgtcgttatattcaaacgcaatgactgttcccgatagttcattgatgagatacgcatagcttccattcggtgcaaatgtcagatggcggggacccgaaccggcttctactttataagaggcgggacttccttctttcagaaaaacatcttcattgtctgcctttgcattcggattaacaataaatttgtgtatctggtccgtgcccagatcgtctgcaaataagtatttgccatccggcgtgatgcggacacaatgcagatgcggtttctcctgacgttccttgtcggctcccgaacctttgaacttcaccacctcagaagcggggagaagtgaaccgtccttatcgatcgggaagacagaaatgcttcctccactgtaattggcagtaaccacattacttccgttggtaatgatgtagcaaggatcttcgcctccggttttctgcgtattcagcagtcggaaagttccttcctccttattgaaagcaaatgcgttggcagcagcttgttcgttgctgaattcgctgactgcatagatgaatttgccgtcggcagaaggtacgagataagatgggttttccacttccgcttcactgagtgcggttgcggttccgttttcttcattgaatcggaaactatagagacctttactgtctcccgaagtgtaagtaccgacaatcattgtcaggtcctgttctgcttcatgggagccttcggtccgggaagccttttttgatgtacaactagatgtgaacataccgataatacagatggttgcaaaagtttttagcatatataggttctttttattagatagcaacttccttagtctatactaatgtcttgtataatagatgattgcagtttccttgtcgttcccttacgaggacacgatggtttcccgacgaggaaacggtcgtttctctacggggatacttgcgtttctctacgaggaaactgtcgtttctttacttgaaacggaaatctcccttacctgtcccagttatactctactatataactgtcgaaatactcactttgaatgactcccagttctttggcggtatttataatccattgctgctcggcgggagtgagcgccagtttgccactgcgtttcaagtagtagtttttacgtcccagatatccgatcatccggtagcggaacgtgtttgccacgcgcactgtgagtgcatttattgtgcacatgaatcctttggcgtagcgcaccttttcgttcgaacagaaatagtcacatttttcttttatgccctttatatggtttggattcataattggcagaaaaactttgtttgcaggggcgtgttttaaagctatctgtcgcaggcaagtcgaggcttgcgggcaattttcggcagcgcacattccgaatgtgaaaggtacttgagaataatcaaatggttcttccattgctttttggggttgatagtatttattatattccacaaatgtacggataatgttggtaagttggaaataaccggacctacaaatgttgtatgtctgggaaccaagtctgcctccgctcatgatatatctctgtataccggatagcatatcatcggctaatatttgcaaatatatgatggttagtaacaaaagaatatgtatctttgtgccaaagaaaacaggattattgaaaggatatgatgtattatttatcccttatttgtttctcaaatataaaataacgattgttctcttttgattttcagaccgttataaagtcatggggttgactggatttgacagcgggcagaaatggtaggtaagcatgcagtgggtcggtaatttccacttaaatctcagttatcaaaactttatctggcgaaactaattacgctcttgctgcttaatcgaatcacagtagattagcttaatccaggcactaggtgccaggacgagacatcactcggaagctgttgctccgaagcattccggttcagtggtgcagtaacatcggggatagtcagaagcggcctcgcgtttttgatgaaactttagaggataaggcaggaattgatggctttggttctgctcctgcacgaaaatttaggcaaagataagcatgtagaaagcttatgatttcctcgtttggacgagggttcgattccctccagctccacctgaaaacaaatgaaagctctgattatcagagctttttctttttatgggttttctcccttattcccctttttattgttgatttgttatttttcctttttttagatacaaagtcaatttcttatacatacttttattctcttctcttttggtatgacgatatcgctatttggtattgtcaatatttatgtgtttttgttttatatacggaataattagtcttaatcgattcataagtgatatttatttaaaattaaatggatgtcatgttcttttttaggacttcatactctttttgcaaaggtacgaatcttttaagtgtgaaaaaagggaatgttacacttgattttgtggtttatgattgatattcaaactattatcattgcaaaaaaaaggtattatccattgaattgtaacaatcgtcctattgttttaatctaaaaaagtctgatttcaatacagacaccctatttattacttggggaatgcaataaagaaattccggtaaatcagacaataattgccgcagtttataattatgtccgttatttgtttgtattctaataataattagagtatatttgtaagaatgtataacacaatgaagttaacttgacttcatcaacaaaactattatatgatgaaaaaaatccttttcttaatggtgatctgcgtagccacatcgcttacttctattttaccggcttcggctcagaattcagaccagaccgacgagtacaaaactttactaaaaaagatcatgacgctttccggcagttcggcatcctctgaagctataatgtctcaattgatgtcgagtatgaaaaatgggcctttccaacaagatgaggcttattggaaagattttgcttcaaaatggacacggaagattgaagataaagtcatggaagtatatgctcctatttaccagcaacacatgacattagatgaactgaaaaaagtggttgctttttatgaatctcctgcgggaagaaaacttggggagactgcaactgccgttgcaactgaatcaatgccgatgatacaacagctgtcaatggaaatggtgcaggaaatgatgccgaagcttcagaaatcaagagagttggtaagggatgacgctgccgaacaggccaagacacgcgatcaaaagttatttgatgcggcttatacagctcctaaagatagcatagagatcgttgccgatagaacctatgagcatggcatgggtacaaagcctttattgcattctattgaaagaaggaaagatgatactaaagtaacgttcctgcaacccatctatttcgactggcaatggatgtactatagcccgggatttaaaatagtagataagaaaaccggtgatgaatacatggtgagaggatacgatggtggcgcacctatggataagttgatgattattaaaggttgcaatcgtaaatacatatatgtcagcctgttgttccccaaattgaaaaagaacgtgaaggaaatcgatataatagaggcgctgactgataaagaggagttgccttccaatgatgacggtaaagctaagtcttattttgatgtaaaagtggacgattatttggtactttccagagaaaacaagaaagtctattattgattggacagatttatctatcattgaaaatgaatataactataaaaaacacaatggtttggattataaccattgtgttgatgtccattgatatatatatatagtattcatggaccctttggaacggcaatatgatttgacgcaagttgtaatagcttggtatcttgtaacgttgctgcttgacttcctttttcgtcataataaaatttatggggtgataaggaacattatagccacagtgcttctctgtgtattctattttgtatttccttaaatgtataataatatgagatatgcagttgttttgataatcaatattatattggtgttggcaggcttctttttactttttggtgatcctttgaataaacagcttccaacgaaaatgatagctatttggttcattgttttagtgatattagattatcctctccgtcataataaaatatacaaagagataagaatattggtatacattatttttcttgctcttctatattggttgtttccgacataggtaaatcattgttttattcatattcatgctcaaataaaatagcctgttaatggatttgtataatgggaatgttttatctttgcagtgtttaaaataagatacgatgaataaaagagtaacaatacaattcgctgactttataaagagtaggttggcaggtggtttgctctgttgccttgtattgttggctgcttatctgtttcagatgtttttcccaggaatgtatgttgatgcattctcgtcatctttttatctttttgcgtggttgattctctttgtgggcgcactcctatggacacttcgtgagaaaggaacatctggattaccctccgagataactgattggcaatgcattgctgcctttttgttgattgttgcaaatcagatttatgttgttatgcctaaggaggttcacgttgaattggctcctgtaatatctgcttatactttacctgtgctggtcattgtcagtttggcaatagcagggatagttaagttgtctatctcattctatcgttcattggaaattgaacggcaaaaaacaattcttcaagagaaacggcttcaggaactgctgtcttctcctccacctgtgttggaaggcgtcatatttgtgcgcagacttttagaaaatcaatctatatatcaattaactgccagtgagaaccttacattaatagaaggatgccgtgcgattgatcctgacttttttgtttggttaaaagataagcaaataaaaattcctccacgtcatattgtatattgtgtacttattaggatgaggaaaactaagaaagagattttgtctatttttgatattagcgatggtgcttgccgtgccatgaggtctcgtgtccgtgcgagcttaggtatagaagatgaggacatggaaacctttttgcaggagttacattaggtaatctctagtatgtttattagtcctataaaagaatggattgctgatataaatcctcccataatagcatagtagaaccatacgcgtttattcgaatatttgttttgagggaatgtgtcgatggctccgattatgagcacaatccatgctagaagttcaaagaaagtaataaggaagtcttgaagagaataatttatatcatcaataaagcggtgaaagtaacacatagtgatgctaatcccccacattatattatataagattatatatttaactattttcatttattagctatacattctttgtattccttgtttgctatatctttggctctatcatattttgcagctgcttgtattaagcagccagatggcattgaaccattttgacagttagcgatagcattgtcataatcagcttttgcctgcttatatgccgcttgtttttgttcttcacagctactagtacttcctccttcttcgcgtgttttcaggagttttacttttgtaagttcgttactttctgcatatagtataaagagttgtgtccgttcatctgcgcttaatcttaaaaatcttgtatgtttaatcaggttttctttagcttttgccagttgctgtagttcattttctagattggctttcctcatgaagtcttccacgtagtcatcatcattcagattttccataagtttgtcatattcttcttcacttaaaatagaagtgtactcatgaaacttatcagctaaaagctcggagctcatttcgaattcccaaaattcatctgaactggcgatggaatcaataagagtgcttccattatttatcatttttgatgaaagtgcacgtgtattagttacctcgtttttttctatttcttcagagtaatatccgtctgcgctacaactataaataaaaaaggaagctaccagtccgcaggctaatgccattacataatacaaagtgtattttttcttttttgtgatcatattctgttttatttaaatgtgtatgcaaagtaacgaaaaatagacttattttagggataataatcattcaataaaaggaaaatatttggtctagtgtcaatttggtcatgtttgtgatgttacaatttagtgtaaaatatgaaggagaatcgctcctagaaagctcacaggcgctatatgatagcttattggtgtaacacattcgttgttaaggtttagtccagtcgttattatccgaaataaaaaattaagcttaactacttactgataagtacaagacttgataatgagaagtacttaagttgtctgattcttgtacatcagttgagtaaaagatgtacaacgttggagtagacgatgtactacgattgaactaaagatgtacagcgtttgatctatactattaggatgtcaaatctgaaagggctgaatgttggtatcactttaaaggataatattcattcaaaaaaggataatatgtggtcagagaaggaaagtttggggtatttcggttgttacaatattagggaaaataaaaaaatatcctcgctgtaatcctcctgtggcacattctacatgctgtaggagtgtaacgccctctttttctatggcaaaagaacttgtaaatttgcagaaaaataacacgaaatcatttatctctatttttctgataattatgaaaatattcacaaagttggtatctgtctttttgctcgtagcaattggtagtctctttttcttttcatgtgctgaaaaagaaaaatgcactccaatggtttcattccttgaaaccgctcttcagcaggcaggagagaaccgtgtggaactggaaaaggtcttatctcattataaaactgatccggcggatagtttgaaatataaggccgcttgttttttgatagagaacatgccttattacacctattataagggcaagcagttggaccgatatcttacttactatactttactacaggaaacacgtggattggggatttctccccaagtagtggctgactctgtttgtcacatgtatggggcattgtatttagattctttgcaatcctatagagatattgaaactgttgattctgcttatttatgtaataatattgaatagtcatttaaggtgtggcaggaacaaccatgggggaaacatgtttcgtttgcagatttttgtgaatatcttcttccttatcgtattggtgacgagaccttgactagctggcgtgaatctatttatcagaagtataatcctttgctcgattctttacgtgcatccggagtacttgataaagaagacccgattgtggcagcccgttgtttgctcgattcaattcgtaaaggaggagtggtatttactactgccgttcctgccagccttcctcatgtgggaccggaagttgcgcaactgaaagcaggtagttgccgggaactttcagactttgtcgtttatgtttgtcgtgcgttgggtattccgtgttcaattgatttcatgccgattcgcggtgatgagaatgatagccatcaatgggtagcattttcagataagtatggcatactttattatcatgaatttcctaacggtgtgagtgaagtacgaaaagacgcaatgtgtggaatgcccaagataaaggtctatcgcaatacctttagtctgaatcgtgctatgcaggaagaaatgctgaaattggatactgctattgttcctcttttcaaagatccgcatatcgtagatattactttcccttataccaaagatttcaagaaagaactccacataccaaaggacgctctatataaaggtaagccacgttcaagaattgcttatctatgtgccagcaaacggatggattgggagcctgttgcatggacagagttcgatggtaaaaacattgtctttacggatatacaaaaaggacccgtcatgcgggttgccacttacgagcgaggacgacttcgtttttggaccgatccttttgaaataaatgtttccaatgagtttcattttttcactccttcggatagtgtacaggatgttactttgtttgcaaaatatactttgcgggcagatgagatgtttttgaatcgtatgataggcggaacatttgaaggaagcaatgatcctgattttcgtgaaaaagaagtcttgtacttgataaacgagaaaccgaaaagactacagactgttgttcaatcgtattcttcaaaatcgtatcgctatgtcagatatataggtcccaaagattcacactgtaatattgcggaggcggctttttatactcctaatgataccgcttctttaaaaggtaaagttataggtactcccggatgttttcaaaaagatggttcgcatgagtatacaaatgtatttgatggggatgtcacaacttcttttgattatatcgaaccttccggtggttggtcaggtcttgatcttggaactcctaagcagataggaagaattgtttatacgcctcggagttatgataactatattcgttcgggtgatgattatgagttattctattgtgcaaggaggaataattggaaatctcttggagaccaaaggtctaaagcggactcgctgatttatatcaaaattccagtgaatgctttacttttattatgtaacaatacacgaggaatacaggaacgaatatttgtgtatacagcagctgaacaaatttggaagtaaattcagatatgattttaataaaaacttgatttattttgctaattgtcatttattaagctagcgatatatgatttagtaaagatgaacaagtttaataagtaaataattattaatgattaaattttaaaattatgatttcgagaaagaaaagcctttttttaagcgtatcagtattgattctatttgtggcgttagttgcacaaagttgtagttcggagaatgacgattttgttgctaatcccaactcatcattagaaatgagagctaacctagaatcaatggataatcgtgcaacaattgtcaattctatagccgaatctgatgaattattagattacggaatgaactgtatgttacttgctgagaagttaaaatcatatacttcaactttgactccagaagaatttgatgaacttatgaataacttaaataatgatgattatatgatagaacttgtgagtaaggttgacattgaaaaagaggctttaatggtagagaatgcacgacaggaactattagctaataaaagttttaagttgttagatgagtccgaaaaaatgaatgtttttattagattctctgataattcgcagaatactatgcaacatctattgctaaaaagtccgggtgaaagtgcaggaggtgttactaaagcggaatgtaagcgtagatatgatgaagactacgcttatgcttctgctatttatctatcatctatgctcctttgttcttgtgcaacgggggggcttggtgtatgtctttgtgctattggtgcttctgctggctatgactatgcaacaactcttgctgatcgtagttattatgattgtttgtcaaatgctatagatcgctaaatgaggtattataatatctttatagttttagctatactatctgtattgctcatgacaattaatagaaactataattatttgataaatgactggtatatttcaggtgtttatgtgttaatgtgggtctttctttttctttatacagtaagtaaagttcctaaaaagaaaaaaggcttgaaagaatatcttcctagcattttagcctttcttgtggttctattaaatgtcttggatgtgcttagaagacatgttatgtgttaaaataagtagatgaaaacttaggaataaatacttaatgttttgtggtttataatcaactttttatttattccatgcaagttcttctcataacaaacagttaaaccactatataaaaatagtatttcatgcaaaatattattcagcatattgcatcaaaatagcaggaaaatcaatagaaagtcctgcataatttgcagtagacggaactcttcccttaaataatcccattgacatatatgcatctgtaatataagctaacgcaacctgcccatcattcattaatacaggagaaagaataatttttccctgtaaatacaaaccatcatcagttttagttattattgagccgtacatcactcctccttgcccatcagacaaagcataattttgctgctgtggagtggttataactaaagctccatcttgataggtgaccgctaaaacaatcgttgctcccaacagtcttgtcattggtagctggaatatatagccattaccacccggatttttaacaatttgagtattttcctctaatgaaagaacttgattaataccaaatgctgtagcaacgactttcacaacacctgtccattgtcccaataagtcatcaatatcgtactgcaataaagcatattcaatttcacgaatgccagtagtcacttttacaatggccgaacgaattttaccagtgagattctcttttgcaataaacttaaatccatcactcgtcatttcataggataaccattgagaagcatctgctggaatagatacctgaataggcaaattactcgacatttcaacagggacctcctctgcagcatctgtcaatgtgaaataggtagcatctctattatatttccaaatagctccttcctgcagtatggttgcttgctgcgtactcacaccatcagttaaaacgatttgtgcgctacgccccggataacctgtattagcatctacagaaatggaaactttatgatctgcaacttcgattacctgacaccaatcggcattcaccgtagccgtgacagttccagttgctgcaaattcgacagttccagtgccaccactagctttcatatccaaatctgattttataattgtcaattttacagtggcagcatcgtcatctgaagaacatcctgcaacaaaaaataagcagaatattattaagtataaattcagtatatttttcataatctagttttttatttattcctcaactttcataaagaccatctctccatacatacgttccaccccttgaacatatgaactttgactataatcaggtgccgaatagcggtcgaaggccatataatcagcttttgcaccacctactgcttcgaataccccatcatcctcaaatgtaaatccaaacggagactgttgtacatttgccacaaaaccaaacatcagacctgcctgataactaatatatgtaggataaaatcccatggcataacaatatgtagtacatcccaaataatatcctgatatataacctaccttttgagtcttaaaggacataattccttcacctctatcataatcgagcactatatcaccaattagtcccctgagaatataactcttattttctacatcctccataatagatattggtaattcttcgtctgtcaaattattatctttatacatcttgcaggtaagagtataattacctagataatcattatatttaatatatccctccggataaattcctttcattttaacgttagttgccccctcgtcagtacaagtaaaaagctcggaggaagggtcccacacaaaattttgcacagttactcctgccagtgaaactggttcccggaaacgaaagccatcggttgtaaaaaggaaaggagattgctcttgtacaatgttaccaccatcattataggctataacaaaagtataattacttcgctgcgtcataccaactaaatttccatcaaccaacaactgatattgtataaagaaagcattctcttctacatcattcacagagtttatatatgcctcccagttcaaatcatccggaagcgcatacattactatcgtatttccatactttttgccctgcattacaattttctcggctgaagcttcctttataataaactcgtaatctccttgcaggttggcattggggttggaacctccgccttgtggcttggcatatgcatgaataaaagcattataagtgtcgaatgtaagcatagtagcttcctccgatacaaccttataaagagaggaaatagtctcatcgccttcgtatccttgagatgccattgtaactcgctgaccatcaaacttgcacagaagagttatgcctcccaaagcatagtcctgacctatgtaatattccattctccaaccattagatgccgattctaatagctcactatattgcttcacttcctctgttgcacggttcgctgaagaatcatcaaaataatcctcttcctggaaaagacaggattgcaaaccaaagcatacaagagccatcaacaaataaatcattatattctttttcataatcttcctgttttattcaatagtacttaaatccagctccggaatttcttgctgacgccttaacacaatctcacgcaaatcatctaaattaataccccaagtttcaagcatataattgtatacaatagtaaacttctgattaataatagccgctccggcagttccggcaaccttcagcatattatcccagtaagcctgatcgtgagtaacatacatggcgatattctctacaaaatcttctcttgcctcactcatcgcatatgccgtcacaaatccttccggccatgcatccgcatcctctcgcaaatatgaatttccattttcagcaacatagaaataccagtcggaaccaacatattttccttcggtaatgcgatcaaacgatgggtcataattacgcttctgatgcaggatatgtgcaaattcatggtgcatcgtcttaaagtaatactcattcaaaacttcgatatcgacattctcaaagtccagactgttcacttcgtacaatgttatcttctttcctccctcggcagtacccaacaccttcgtaccactgctatcataagccggagaacctatcaagtgaaaagtttttggcacataagaccgaagaaaagccggtccggcaagttcagtatatgcctccatccatacatgcttgataatcttggccaaagcaaccgatttatcgtaatccgccggtaccagattatatttgtgatcactttcaatatcttgcatacgatacttgaaatcaacgttatacggatatgtataattagcaagcaaccattcatcaaaaccattatgttccattggctctgttgaaaaaatactatgcttggtgtcaatatcatcgccattattacaggctccccaaagaatgggcaaaacagccgttagtatataaatataatatttcttcatattatttcctccttttaattttcagtacgtggattgggttgcattcctgccagaactacactcttaggaatttgcatagcacgtcttgcgtcatttaccggcatttcatctgttacgactatattgttattagcaatagaacggcgatagataacaattccataacgtttaatatccggccagcgcagaccttcgtgcaaagtagcaatacgtctcatatgcagaatgcagtgaataaagttctcctgtatacctgattcaatagtaaaatcaggctgaagctttttcttgggagtcggattttgtgtcggattgtaataatccatcttatcataatactcatttatcatccccggagttaaagtttgcttattagaagtatatgctttctcccatgtagtaagatctgcagcagccattggatagttctttttcagcgtataagcctcagccctgcaaagcaaagtctcgtctgtagagaaaatcacaggcatataatacaggtagtcaccagcataataaccgccctttctcaacatactgcattcatagcccgatgttgtaaaaggctgcatatacatgcggtcagggataccccataatccggaagaacgtgatgtttcgtaagaagcaattaacttattatgtagataacgttttcctgtcatgtaattactcagaataataccccagttagatacggtactacctatcaacaagttagccttacttgtagaagcaatatatgcgtcgggctgtacattatcattagcagagagttttcccaacgcttcccaatcccgtaattcggcagcaggatcacttcccaacacacgatctgcatattttatcacctcatcacaattagaaaagtcaggcttcatataataaagatagaaacgtgcagcaaaagcatatgcagctttccttgtgaaatgatatttcggcacagaataactatcatcggaaataagagccataccatctaataagtccttctcaatcttctcataagtctcctgcaaagtaccccgcccgtattgtggttgcacagttgtttcaactttagtcatataaggaatacctaattcctgtgatgcatgagtattataagcattacaaaaaatatttgctaatacaaaatgattgtacgcccgacaaacaagagcctctcctcgctgcggcatcaacgattccggatttccccgtttctcaatctcttccaaagccatgttagcagaagcaatagctatataatgggtttcccaaagatttgtaggcgtatcctgatattcttcctgggtatctttccagttatagcactcttcctcagataacttataataagaatatctggcactgttatcgtcggtattatcactataaagttcaaacagttcattcgcagatccttccggataagcagaaacaagcattttagctattttttgctcagaattcagctccgtccggttatctggtaattcgtcaagaaaatcattacaagagctaccgacaatagcaagcgttgcgatgaacaatggaatatataattgatttcgtctcatctttaatctttttttttattattaaaatcattctcttacaatcctaaacgcagagttaatgtaaactgacgtggcaccggtgaagctacaccaccagtattaaagaattcaggatcttgaccattcaatttcttatctgcataaataaggaataaattagttgcctgtaacttcaaagaaagattggaaatcttcgcagcagaaatccagctcttaggaaactcataagaaagtgagatttctttcatacggataaaatcaccttttgcaattcgctctgtagaataattgtaagcattgtaagctttatacaatgttcggtttgcttcatattgcggattactcaagattgcaggaatattagtctttgcctcatccccagaaagcgtccaacgattcttgaattcacgaggcatagcactcaaatcggaatatttataattaaaatatggattcaaacgaacaacattaccaaatgaataagtcatgaatacattgagtttaaaccctttatatgcaaaaacgttaccgaaactaccagttattgtaggatctgtcggaccttcatatttcaaataatctaacttctcacgttcctggaaattaatatcagtcgatgttatatttccattgatatcgaacataggaatacctttttcatccaaacctgcaaaaggaatggagaaaagcccgcgcacaggatatccttcacgtgcaaatccatttcccgaaacaagttccatcatacgagtacgtcctcgcaaatcagtaacttcattcttagcatgagaaaaaataaaatcagaattccatgagaagtctttcgttttaatattgctggttgaaagggtaaattcaataccatgtgacttcattgtagctacattggcatatttataaatagtacctcccactccttgtgttggaatcaacccaatcaggtcatagttattgcgcgtgtaccagtcagctgaaagattaatgcgattattaataaaacctacatccactcctatattcaattcatgcttcttttcatacgttaattcactattttccaaatccactatatgaagacccgtttcttgaatatcagtgaaaggacgataaggtgaataactcttaataatagcttgtgaatttgttacatcagccggaccacgatcagctgtcaatgagtaagatgccttaaatgtcaaatttgaaagcgttggttgaagtgattggaagaatttctcttcatgaacattccacgctgcagaaagattccacgttggcagccaacgagcagaacggctacgccccattctattagttccttcatagcggaaagtaccattcagcgtataacgtccgtcatacgaataagtagcatttgcaaatgtagctacactccgatatctagtatgccccatagaataatacttttctccagtctcaatacctttcttaaagtactgataaacatatgatggaatctcacccatagaatattgcataccccatccttggaatgaagagttagagcgttgaagatcatttacttccattcctgcaaaaagattagttatatgcttttctgcaaatagatgattccatgatacagtaccacggaaatccagtcccaacatcttacgatcttgacgctgataaatacctccttcaggaagaatcgaaataggtaatgcatatgggttatctggattcttatacaaccagtcgttttcatcacgaatagtagcatcgtccaaccccgtacgataagcaattgcttgattagaatcatccattatattatgttcttgtgatgatgattgataacgcacagcacccagcgcactgacttctaggccctgcaacaccttccatttcaactccccctggaactttacatcaacaacattcaactcaataaaattattgtccaattcacggagaatattaaatggagcataattagccacataatctgtattaggatctaatgtacgtgaagtattcagtgcgtatgaataggggttgatatcaaaatcacgtgtaacctgacctgccgcaacgtccaatgatgagttcatggtacctggtgcattctgtttacggtaagaagcacttgatatcaagtttatgcttaggttctttaagatattataagtcgtattcaaattggctgtataacgtttcacttcactctgcttataccatcccggatcaagcatggcactcaatgacgcataaaaagatgatttatcagaacctgaagtaatacttacagagtgattctgtgaaatattatttgagaataatacatcaaaccagtcggtattacgcatttcggcttcggtcaaataagcattacgtgcttctaaagtattcatcagcccaaattgaccattcgtttcattaaactggtcgatcagtttatacatacgtccgtacacacctgaattctttgcacgaaataaatcagcactattcaaccaacctttttgctccaattctttatatattcccatttgctcctgagaattcataatattgaactctttgtatgagggcaccatacgcgtagtaaactcacccgtataattaattttgctgactccagctttacctttctttgtagtaacaacaattacacctgccattgcacgtgcgccatagattgaggttgctgagccgtctttcaaaatctgaaagctttcaatatcatctgcgttcagaccagcaatagccgaactaattagagtttcagcatcgcgaatggtgttaattaaatcggaataattatgaatataaaaaaacatttaccttggttgggggctttactccctattattaatgcacaagcggatacgaatcccaatgtagttatcatttatatcgacgacatgggtataggtgatattggctgttatggaggaaaatttgtagcgacgcccaatattgataaactggcacaggacggattattgtttaatcaatattattcttccgcaccggttagttcaccctcccgttgtggattaacaacaggacttttccctattgaagtaggaattaatactttccttaacgacaaggcaagtaataagaggtgcgagcagcgtaattatctggacgacaaacttccttctatggcacgtgcttttcagaatgcaggatatgctaccggacacattggtaaatggcacatgggaggtggacgtgatgtgcacaatgccccttctatcaagaactatgggtttgatgaatatctttctacttatgaaagccccgatccggaccctgcgataacagcttctaagtggatatggtgtgataatgacagtataaaacgttggaaacgcacagaatattttgtagataagagtattgactttattaaacgtcataaagatagtccattctttctcaatctttggccggatgatatgcatacaccatgggtaccggagtttaagcaaaaagaaagaaaaagctgggagacaaaagaggcgttttcgcctgtgcttggagagatggacaaacaaatcggtcgttttattaaggcactggatgatatgggattatccgaaaatacgattatcatctttaccagtgataatggacctgcacccagtttcaaggctgttcgctccgcttatttgagaggtaccaagaatagcctttacgaaggaggtatccgtatgccgtttattgtcaaatatcctaagaagattaaacccggtcgggtgaataattcttcagtgctatgtgcggtggatttatatcctactttatgttccgtggccgggattaaaactgagaagaactataaaggtgatggacagaattatgcaaaagttttgctcgggaagtcggaggcaaaacgaaaaacggatttaatgtgggactttggtcgaaataagcattttggttttcccggcaatccttacgatagaagtccgcatctggcaatccgtagcggcaagtggaagctgttggtgaacggagacggaagcgatgcacaactatatgatatggagctggataaattcgagaagaataacatagctggcgaacatccggaattagttgcaaaactaagcaagaaagtatgcgaatggtacgcccaaaacaaagataaaggattgcaaacagacctctaattaaaaaaaacatgaattcaaaagcttttcttttgccggcagcactgatgatagccggcaattccgttgcaaactcaaaagggaaaaaaactgataaaagacccaatatactggtgattcttgcagatgaccttggctattctgatttaggatgttatggcagtgaaatccatacacctaaccttgataaactggcacaacaaggagtacgcttcaaccatttttataatgcgagtcgtagttgtcccacccgtgcttctttgctgaccggactgtatcagcatcaggcaggaatcggacgaatgacttttgatgacaacctgcccgggtatcgtggcacactttcacgtaatgcggttacgatagccgaagtgctgaaagaatctggttacactaccagtatgatcggaaaatggcatgttgctgaaactccattgcgtaaagatcagcgtgaatggctggcacatcatgtttaccatgacacctattcggatttatgtcactatccggtaaaccgtggcttcgattctcattacggaactatttatggagtagtagattactttgacccgttcagcctagttgaaggagaagtacctgtaaaagaagtaccggaaggatactatatcactcaagcactttcggatcgtgccgcagaagaagtaacggaatatgccaaggatgataagccgttcttcatgtatttggcttataccgctccacactggccgctccacgccttgccggaggatattgaaaagtataaggatacgtacaaagtcggttgggaagctatacgcaatgcccgttacgagcgtcagaagcaactgggaatatttccgggaatggacgattttttgtccgaacgtcagtttaaagacagatgggaggacaatgctcatgcggaatgggatgcccgtgcgatggctgtgcacgctgcaatgatcgatcgtatggatcagggaatcggacaggttattgacgcattggagaagaccggccagttggataatacactgattcttttcctctcagacaatggttgcagtaatgagaactgtcagaattactctccgggagagaatgaccgtccggacatgacccgtaagggagaaaagatggtatatccccataataaagaggtattacccggaccgcaaacgacctatgcttcattgggtgcccgttgggcgaatgtggcaaacacacctttccgcttttggaaagccaaatcctatgaaggaggaatctgcacaccgatgattgcgcactggccgaaaggaattaaaaagaatgtaggcggtatgacaccggagataggtcatgtgatggacatcatggctacttgtatagacatggctggagcaacttatcctgctaaatacaaaggaaacgatatcattcctatggcaggcaagagtttgcttcctattttcaaaaccggtcatcgtgaaggacatgattatctgggcttcgagcatttcaatgagcgtgcattccttgccaaagacggttggaaactcgtgcgtccgggcgagaatgccaaatgggaactctacaacttgaatgaagaccggagcgaacaacataatctagctgataaatatccggagaagaagaacgaaatggtgaaagcgtacgaggaatgggcgaaacgctgcatggtagaaccctatccgggacaaaaaaagaaataagagcattatggtaagaaccaacttcttaatgactgcccctttattgatggcatcattttgttccgcacaggagaaaccgaatgtcgtactgattctggtagatgatatgggttattccgatatcggttgttatggtggcgaaatacttactcccaatattgatgcgttggcgtctaaaggtgtacgttttactcagttttataatacttcccgttcttgtccggcacgtgcaagtctgatgacaggcttgtaccagcaccaggcaggtattgggcagatgtccgaagacccttttgcgaatcctgaccagaagagtcctaatgattggggagtacaagggtataaaggctatctgaacaggaactgtgtcacaatagccgaagtgctgaaagaagacggttaccatacttatatggcaggtaaatggcatctgggaatgcatggagaagaaaaatggcctttacagcggggctttgaacgtttctatggtattctttcgggggcatgcagctatcttcgtccatcgggaggacgtgggctgacgctggataacaccaaacttccggctccggatgcgccttattatacgacggatgcttttgctgattatgctatccagtttgtggatgaacaaaaggatgaccgccctttctttctctatttggctttcaatgctcctcattggccgctacatgcgaaagagaaagatatacagaaatttacaaagatatatcgtaagaaaggttgggatgaaattcgggaagcacggcgtaaacggatggcaaagatggggattattgattcaaatacagactttgccgaatgggaaaaccggaaatgggacgaactgacagaacaggaaaaggaccaagtcgcttatcggatggctgtatatgcagctcaggtgcattgtgtagattacaatatcggcaaactgattgattgcttaaagaagaatcataaaatggacaatactcttattttgttcatgtccgacaatggtgcttgtgccgaaccttatgaagagctgggaggaggaaaggtggaggaagtgaataatccggcttcgagttttgcgccgacttatggcagggcgtgggcgcaggtttctaatactcctttccgaaaatataaatgccgtgcttatgaaggtggcatttctactcctcttattctgtcgtggaaaggagcattagggaataagaaaggtaagtggtgtcgtgttcccggatatttgccggacatcatgccgactattttagaagcaaccggagctaaatatccggagacttatcatggaggaaataaaatttatccgttggtcggcagcagtctttttcctgctgtccataagaaaacggactccttgcatgaatatatgtattgggagcatcagaacaacagagcgatccgctggagagattggaaggctatccgtgatgaaaaaggcaaggaatgggaactgtatgatgtcgtaaaagatcggacagaacgctttaatgtggcagaacagcatccggaagtattgacaagattggttacggaatgggagcgttgggcgcatgcaaactttgttttaccgaaacatccgaaaaaataaaagaaggacagataatgaataaactgatcttgggggcgtctatggtagtaagtgcaactacattgtcgtttgcacagcaggtagaacgccctaatatcgttattgtacttgctgacgatttgggatggggagatgtcggatttcatggcagcgagataaaaactccttgtctgaacgctttggcagcagaaggagttgtactggatcggttctatacagctcctatcagtacgcccactcgtgccggacttatgacagggcgttatcccaatagatttggcatacgtacaaccgttattccgccttggcgtgaagacggattggatgaaaatgaagaaactctggccgatatgttggcacgtaacggatatagtaacagagccattatcggcaaatggcatttgggacatacccggaaggtacattacccgataaatagaggcttttcccacttttacgggcatctgaatggtgcaattgattatttcgatcatatgcgtgaaggagaattggattggcacaatgactgggagacttgttatgataaaggatattctactgaattgattacccaagaagctgtcagatgcatcaatacttatgagaaagaaggtccgttcttgttgtatgtagcttataatgcccctcatacaccgttgcaagcgcaggaaaaagatatagaactttattgtgatgactttggtagtctgacaccgaaagagcagaagagagtaacgtatcaggcaatggtgtcctgtatggatagaggaattggtacgattgtggatgctttgaagaaaaaagggataatggataatacatttttgatcttttttagtgataatggtcccgccggtgtaccgggatcgtcatccggcaaactacggggcaggaagtttgacgaatgggacggaggtgtgcgtgtgccggctgtcttttattggaaaagggcggaaagtaactataagaatctgagttctcaagtgactggatttgtagatatcgttccgacattgaaagagttagtaggagataagaatcgtccggaacgtgcgtatgacggaatcagtatacttccgttgttaataggtagtaccagttgtattgaccgtaatttctatttgggatgtggagctgttgtgaacaaagactataaattgatcagaaaagggcgtaagccgggattgaatttgccacaagactttctggtagactatcaaacagacccttacgagaaaaagaatgcttctaatggaaatgaacagattgtgagatctttgtatcaggttgctctgaaatatgataccattactccttgtttacccgagattccttatggtaaaggacgtgaggggtttaaagcacctgtggagtggaaagtaacacgctgaatgaatcgggccgaggcattccgaaatgcagggtatgtgttattaattcgagagactactcaattataagacagcctctttattatatttacatatctttcaatcccagaacttgtgtctcaatatcatatttagacatttctttttgttttaaatgttccactttctccatgaaaacagtatggctatagttgttctcaggaactcgtttaacttcagcaataagagctttcttaccactggatttaagagcaacaatatctatttcataagaatttattcgttgtttgccaatagaactttttgtttcccaccaagagcctatttccttgaaacctccggtttctgccagtttctgtttgaagtatttctctaacaccctacctgaataggtcggataatcagcttttgctaattgtctcaaatcatcaaaattctgtaattcaatataagagcgattctgctcaatatatttaaaccagaaattcaagaaattatcaccaataacatatcgtacatttttcttagttccgggttttgcaaaaataggacgttcccgggttattaaattgtatacattctccagtttgcttaaataacctccgatagctgtaccgcccaatgccgattctatctcgccttgcgtatagtgcccgttggcgatttctgacaaaatggaaaaataggtaccatagtttttcccaaactcagttatcaataaattacgtccttcatctataaacaaggagttttccgaaaagacaaagtcatacatcttatctatagtaagcgcttggttatcacaaaacaactctacatatttagggattcctcctgtcaacgtgtataaagctaataagtcatcattgctatatccggaagcaagatcctccattatttgtttcaggacaccgatcttaaaagcacgcagacataaaatattgtcagcacgcccaaataggggttcattatgatcagtgaatattttctgcattaaggagtacacagaaccactgatgaccaaatttattttagtttcttgtttatactcatcccaaagattctgcatatcactaaagacgtcaggtcggatattataaaactcttgaaattcatctatgacaatattaaaagcacgtgttttaccaacttcaaaaagatattgcatcaaattggtaaaagtaggtattccttcaggaacgaatatggatagagtttcacgtactatctttacaaaatcagtaactaatatgctttcagcttttcttccaatgaataaataaactgtaggcgttcctttcaaagcctcctttatgagactggttttaccaatgcgtctacgtcctgtgaccacaatcattctggaattttgagtaaatgcaagctcttgcacacgcttcaattccgcaacttctttttctctattatagaatttcataatgatgatttgttttctcaacggccattgactcaaccgctgttgcgaaaatacaaaataaattgagaacaatcaattttagcatgcaaattatgaatgtttcatcctatattataattctttaagtaatgcagattaagtttctaattccgttataacatatctttctatatgtccaaacatttttataacatgggggtatatgaatcggattagaggaaatatgagttaataagaggaaagaaaggttagcccgccatgaaaaaagaatatccccttgcgaacgcaaagctgcattcacaaggggattgaaagatctttattaaaaatttttttccttgaaaaatttacgcaagtgcactaccgatcaagaaggtagcagccaaagcaacgatagcgtaaagttccgggaatacggcaagaatcaatgtattactaaacacgttgtgtccctgaccgatagctgcgataccgtttgcacaaacttgtccctgacggatagccgagaacaatgcaaccaatcccaaagcaatacctgcacccagaactgctgatgcctggatcgcagtgatttccggagtcagaataccgaagatagtctgaaacataaagtaaccggcaaaaccgtacagaccctgcgtacccggaagtgcagtcaatacaaggaagttaccgaatgcactatcattctttttcaatgcgccgatagcagcgttacctgcaatagttactccgtaagcactaccaatgcctgacaaaccaaccataaccgcgatgccaatgtaggcaataaacaaattcatttccataatcttattctatttttattgtttaattcttaacttgttatttctcaatattctattctaaatttctaaaaggcttgtattccttgccgcctccttcataaccggagttcttgaagaactccacgaatgtcagacgcatcgggtgaaccattgcaccaagcacattcataaacatattgatggcatgaccgatcacaaagatcagcaccattacaataggacctgctatcacgttatccggactcatacctactgccagactgttgaacactcccgccagaatacctccggaaagtccgagggcaaacagacgaacataggacaggacatcccccagcagacctgtagccatgttatatgaatcccataacccaagcccgatattcataaagatgttctttcccggactattatagaggaatatcatcgcaccggagatacccagaataaccagatgcaccgtacctcccatcggcagcacgttcggcaacaaagccgaaacagccaatgaaaccaacaggataatccatccgattgtcgctactgcatacttgaaaccaaattgaattgtctgattcaccgctttgagtaccataccgaacagaatctgaatagcacccaagatcagtgacaactggaacatatcgttgttgtccatcagaaccgcatgtttcagacgttgcacgataggccagtccagatcataaatgttcgctccgaagaatgtacctgtcagcaaaccgcagaagaaggttgaaacagccagcacttgtatcagcgacaggatggacttcatggatggagtcaccttctttgccatcaaccggtatgccgtagctccgaggaacaggaaaagtccatatccggaatctcccagacagagcccgaagaaaaccataaagaacggggcaaagaacggtgtcaagtccagttcgttatacttcggaagcatatacagtttacagatcggttcaaaccaggcaaagaatcccttgttattcagccgaataggaacattatcacccggcatcggatcggtaatctcataatatacatgtgcatcgttcagataagcctctatctctactttactgtaggcaggagcccatccttcaaccagcatcagtttatcaccggctgcctgttctgaactcaatactactttagagaattcaatctgtccctgcaattccttcagagctgctttcagggaaggtacatctgtttcagaaagtgcaaccagtttcttttcgttctcttcaatagcttgttccgttgtatcatacaacgtttcaagatgtgccagcgaataagcgggaagtttggcctgttctacatccagatctacttcctgaccagctttggtgacggtcacaaagaacactttggaagaaatacggttaatgatcatcgcattgtattccgtctcccattcttctttatagtttccttccgaacagctatagaaaccgatcacatagccggcatctttcaacttccggacacctgccggatcaaagttgccccatgcctgcaatgcctccttttccttggcataaccttgcagttgctgagacaatttgccatgctctgtctgcaaagcatccacttcgtccaatacctgcaaaccacgagcggcagttcctccttccgctgcaattacagcattcttctcatgcttctgattttgaagcagtttcagagtagctgtcaagcggtttgaaaggcggatattttcttgcagttcggtattgtcggcggcaccttgttgtttttccacaatgtggaccacgccaagttcgcgcaggctattcaggaattcttcgtattccttatgataaaccaggaatgtaagtttcttcatttttgtaatcatgcctctacctccttccttttttcctgatgggacttcatgatcttttgcgatgatttcgacaggttctcttcatcttccataaaccgcttgatctttcgcaatgcatcctgatagcccggtatctgtaccttctcaaaaagattcaccttctgagtggtctttttcctcgcatgttctagcaggttcagcttggcgagcataaactcacgttcaattgccgtatgagcaagttcctccagcaaatggataccgtcggcataccatttgggagcattaaacatactgtacggacgtatctcgaaatcgatattttcgagtagcggtacacgtacacccgcaatctttttcacgccaagatgaacatcattcacctttatcaatgaagcgtcaaactcattccaaagggcgaacatggcttcataggcttgaatttgttgttcgagcctatcctccagatcggcagcttccgttttacagcgtttcacttccatgcggagggcgctttccttattcttaatgataggaagcgtacgcacccgcactttcagttgcttttcgagctgctgaagagaggtcttgttatattgaaactttatagccacgttgtttttgctaattattagttataaattactagttgctaattattcacctttcggccagtattggtcaacaagttccttcttgatattcacttcttccggacggaaatattcaccgaacaagccccaggccacatccagcatttcagtagtatcaaggttgacatcaatggccagcaactggttagaatagtccttcgcaaaagccaacgtacgttcgtcgtaattggtcaggtcaaaaccgttttccatcttagtctttgcatttgcagcatcggcatacagacgtacagcggcattcatcacctgcggatggtctttacgtgtctttttaccggttaccagctgtttcagacgagacaatgaacggaacgggtcaacaataaccttaccgatatcactgtcacgacgcaagaacaactgtccttccgtaatataacccgtattatcaggcacagcgtgcgtgatatcgccaccggacaatgttgtcaccgcaataatcgtaatagaaccaccggaagggaactgtaccgccttttcgtaaatcttcgccaagtccgaatagagcgaacccggcatagagtctttagacggaatctggtccatacggttagatacgattgccaacgcatcagcgtagctggtcatatcagttagcagtaccagtactttctcattattgtttacagcgaaatattcagccgcggtcaatgccatatccggaatcaacaaacgttctaccggaggattttccgttgtattcatgaaactcacaatacggtcgagagcaccggcattagagaatacgttcttaaagtacaggtagtcatcgttagtcatccccataccgcccagaataatcttatctgtttcagcacgcaatgccacgtttgccatcacctgattaaaaggctggtcagggtcggcaaagaacggaatcttctggccggataccagtgtattattcaagtcgatgccggcaatacccgttgcaatcagctccgacggttgtttacgacgcaccggattcactgacggaccaccgatttccacttcctgtccttcaatttccggacctccgtcaatcggatcaccgaaagcattgaagaaacgtcctgccaactgctcactcaccttcaacgtaggcgatttgccgaggaacactacttcagcgttggtaggaataccttccgtaccttcaaatacctgcagagtgacatcgtcaccggcaatcttaaccacctgtgccagtttaccgttcacagtggcaagctcgtcataccctactcctgtcgctttcagcgaacaagtagccttggtaatctgagtaatcttggtatatatcttttgaaaagcttttgttgccatctatatatttacgatttagctatttacaatttactatttaacgcttctttcggcaatcagttcttttaattgctgctggaacccttcgtactgctctgatttgaacttcgagtagttcatctgcttacagacattgatcattttcttgaagtaatccattacttcattgaagttttcaaattcaaattctgtatgacagatatctatgatcatattcaggatagcttcctgacgttccatcggagttaccgagtccacctcatcaaaggcatcctgctgcaggattacgaagtcgatcagttcagatttccagaagataacatggtattctacaggtacaccgtcatcacccagaatgttgatttgttcggcaatttctttaccacgctgcaaacgggttttaagctcattcactttaccgatccattcatcattgatatgatctttgatatattcttcaaattccggatattcgatatatttggaatatgagtcaatcggattcacagccggataacgtttcttgtcggcacggtcctgttccagtgcgtagaaacaacgggctaccttctttgtgttttccgttacaggctccttcaagttacctccggcaggtgacaccgtaccgataaaagtaattgagccggtctcgtcgttattcagttttacataacctgcacggccatagaagttagaaataatagcagaaatatccattgggaacgcatccggtccgggcaattcttccatacggttggacatttcacgcaatgcctgtgcccaacgggaagtagagtcggccatcagcaataccttcagtcccatcgaacggtaatactcagccaaagacattgctgtatatacagatgcttcacgggcggctaccggcatgtttgaagtatttgcaataataatggtacgctccatcaatttgcgtcctgtatgcgggtccaccaattccgggaattctgtaaagatttccactacctcgttggcacgttcaccacaagccgcgataattacgatatccgcttctgcctgtttggaaatagcatgctgaagcactgtcttgcctgtaccgaacggaccggggataaatcctgtaccaccttctacaatcgggttcagcgtatcaataacacgtacaccggtctccaacaatttgaaaggacgcggtttttctttataattcgtcatagcccgtttcaccggccatttctgaatcatagtcaccggaatgtcatttccttcctcgtctgtcagaatagcaattgtatcttctattttataatccccttcgggcataatcgtttttacggtagccgttccattcatagtaaacggagccataattttcagcggctggaagttttcatccacttgtcccagccatgcggaagccaccactttatcaccggcgctcaccatcggaacaaaatgccatatacgttctttatccaacggatatgtatattgtcctcttttcaggaaaacaccgtccatcttgtcaaggtcgttttgcagaccgtcatagtttttcgataacatacccggacccaaggtcacttcaagcatgtgtcctgtaaattcggcttcggcgcccaccttcagtccacgtgtgctttcgaacacctgaacatacacatgcgaacctacaaccttaatcacctccgccatcaatctatcgccaccggtagagatataacaaatctcattctgagctaccgggccgtcaacgacgagggtcaccatgttggcaataacgccactaacagttccttttgttgccatatattttttttaatttattatctgaattctgcgggaatctgtacctcattcttcagcgattcaataatgcttcggaacaattgatttcctctttccttatccaatgaaatccaacgctcaatcatttccagcttcagtaagaaagcgaaaatacgttctacagtgaaataatcgaagaagatagcatcttccatccagttccaccgcagagcatccaatttcttttcacgttccaccagttccgtaatctcactggtcttcaccaacgattcaaaaacatccacttcaccggacaaaccaaaatcgcgggcactggatgtacgcaaagcttcgcacacttccgtatttcctacaatatgggaagcaatatcccatttgaatttacgggctgtaaatgcaacaagaatattattaatgttcagattgaattcaaaccaggaagagacgaacttatttccgcatttcatagcatgttcataatacagagcagccagatggtcttcctgcaacactatgctttcagccggagtattcagatagtcggaaataaaagtagataaataggaagggaattctttaggactgatctcaccgccttctttcagaatagaaatatactcggtgagttccgcagcagaatagtttccccgtctgtctatttccgcctctttgtctttgaggagtttcaacacgttggcattatcaaacttcagatagaacaggtcaatcaacttctggtctgaagcagacaatccactgtagatttcggttttaaaatcggctactgtatagctcagtttactgtcctccagagtgagttccggcaaaccggctaccaagtaatagtatttactactcatagtcgcttcttttaaaatagcatttctaccaattgaggacgcaagaacgctttgaagtaattcatgaattcttcttctccgaagttcaccttatatgaaccgtccgccggagaaaccgtgaataaagttttgataccgttcacttgttcgatcgtcacacctttatccagcagagcttttgcatgagctgcgaaatactttttcagtgattcagcgtcagccgttgagatgacaataggttcatctacactccatttggatgccagcgcaacgataaacgcattcagataatccttatcctgagcgaaatccttcacagaagcggttatcaacttgtcagtgaccatcgttgcaatctcggatttgagtgcattgacagcctgaccggaaaatagttttaactctgattttgtattatctgccagttcatcagcagatttacgagaggcagcaacaattgagtcagcttctttacgagcatcttcaataatcttctttgcttcttcctgagcattcgcgataagtctctgcgcttcctcgtttcccttttccacgccttcacgataaatcttatcggtcaactcttgaattttgttttccatattaacaggagtatttagtattattactatattaactgtgtgtctctgtaagattctcgccaaatttacaaaaatcaatttgataaaaaagagaaagacgcaaagaaaacgcctctcttcttataaaatcacacttttacaccaattttattccggttatatcctagtaatattactaaatgacacctgctttaaaatataataaataccatatcgtatatctctcagcattctagcattatccatatcctcaggtgaagcaaagggattataaggatgagaatggatatctattattggtataaaggtaggaaataaagcctcttgcactttagttaatccatacatacttgaaactctattcctattattatttgtacctaatataaatgttctctttccatccatataacctcccttaagagtccattccacacttgtattatccgcaacaaataaaaaaacattagcagcattatataccgagtttgtcgtagtgtaaagcttacgatcccaatagtctctccccttttcccctttactcgccgttaatccctgcaacatagatttatcaaacacccgaatacttttccaatttggatcaggctgcgtcgctttttgagaggaattaataccacttgcatataaaacatctactatcctatcagtcttacgcatcaagtaaactgctccatttgcatttacaacataatcatcttttccatcagggtcaattcgtattattggactatttttacagtaagcatataaccccaaagcaggatatttttctcctgaaggatctactgcatgccatcttcccaacgaagcatcatacattctcgccccataatcataccaatccaaaccattatctctgttcagttccttgccgttatacttataaggctgaacattattagacaatgatgaagaaagcaaccctccgaatggataataatcattcacttcctccaccacaccattttgagtgacaaccacacgattattaccttgatgatcctgaataaagtaatgaaattgattattcgaaacggtaatgtaaccatcttctgtcaacacctttatcaacacaccattttcatagatcgcattgccacaatagtctgttatgatagtggcatttcctgtcttatacgtagtacggagttttgttccatcagccgcgtagaggtaagaaatactgttaccaccttcaaactgcaccttctccggcaaatttaaacaattgtattgaatgtcagctatctttttattcaaatctttcgtcaaattaccatttgcatcgtattcatattctatctctttacttgcgccatccttgaattccataccgttaccgaatacatggcccgtagcattgtcgttgacagactccaattggttaccgttgtaaaccaagtttaaattatcaatcaagccatagctcattgtattggtttgcccgtaacggagtaaaccgaggatgtttccgttcttgtcatagcccgttacctgttcagtgaagtggttcgtattattgcttaatagttctccttcaccataaacagcatctttcaagcgggaaaagccgtcatatgtaaacttatagccacgtaatccggcctcacttcccgaatgccaggtcatactactgatattgccattataacaggggacacctactccatcaacatagtgtaacgtttgagaaaagtgctgactttcgattccagtcagccagccacggatattataggataaactctcagacaccttatcaccataattcctgccagtcagacgccccaatgcatcgtatacataagtgattttatcggtaaaacgcccgttccaagtattggctttcgttagtaaccgtgcacgatcatcgtacgtataaacggtttcaaggatatccgtaccaatgttatcctgctttctcaagacattacccgtgaaatcataagctgtatgactatatcgcagtcccttttcaggataatgacagagcgtttgaatgacacggctacgatcatcgtagtagattgtctctgtcaaccagtcatctgtgccaagcaaacgtgttttcgtacttgtggtcaaccccgaaggatacagggtatacgacgtatcatagccaacggctgctacaaacggatgggcagtcacattctccgttggtttgtaattgtcatataccgtatattgcaatggagtgcgagttcccgcaggaagataatgctcgctttcccaagcggccaattgcagttcgccacacgtttgctctgccgataaaagcatttcaccgctttctattacacgatcatgagagtcatagagaaaataactccatttttttgcatcagcagtccggagtttgccgtcttggctcaaaaccagacggtcacgacggtcataaaccatataaatgggagcgcaacccgggagacgtttggaaatcatccggttcagtttatcatattcataactgtatgctaagctatgcagcacggagatatccgtcgtgtcggtctccgccagctgatggctggcttctggaggcagtacataacggagacaattgcggtcatcgtacacatagtaggttgccaagctatcttcaccgttgacagatacagtcagaagagtccgttcattagagtcggtataggttttactccgatgcccatcttcgtctgtttcaacaatgacttccagtttccccgctccatagaatcctgaagcgatcaatgagccgctggaagaaactttatagcactttacctcatttgtactgttcattccgtaagtcacacggacactcttatcactggtatgccacgccttgcccggtcccatcttccgggaaacacgcatcagtggactatcctcatattgagtcagattataagcatatgcctgttctcccgtaccgtagacactccaacgctccggggaaaacttatcaaaggcaccgttgttgccggtctttgcatacggaaggtattccttctctacttgacccatcatattgtaggtataagaaagtaccaaatccgcattacctccaggactgccgcctatctgtatttcctgttctttacggccaaaaccgtcggtatagacaatatcattgacaattcgtgcagcaccgctacccgtttggctactcgcatccatataagttcgctctgccgtataattacgtgttttcgtataacctgtcgcttgctgcccgttcatgaaaagggaaaacgacagcagacagagtattgacaaagttcgtttcatctctattgttttcatattctgcatcttgttttattagttattaagcttgttgtactcatacgtttttaaaatattaccatattggtcttccactttgataactcgtccggcagcatcgtaagtgtaatactctacatttccgctctggtcaaatcgggcatacaccgtaccgtcaggattataagaagtggccttaaaatttgctccttcagggaccaatgccatataagaaccttgagtattggcagttacagaagttatgtctgtgtatttacttaggtcaatatcatatattttcaatttagaagaagaaacgctctcaacggtatatggaacctcacttcctgcatgggtgatgcttcctgaagcagttgcatttccgtccaaaatatatagtcgcaagtttttcataccggaagccggagttaatttggggagataagcaaatttgtatttatctacttcaccatacaatccgtacaagtaatcgaataatgatagtccatcaaattgcatcattgcctccattgcacttataaattgtctcaaaatctcaaactttggatagagtcctatcatccgttcatattcttgtttaaacacattaaataaatcataacatacaatatgttcataataatatctcgcctgactcaaatccggcttacttttcactatttcttcagcaaatgaagctataaaggaatggtcttgcgagttcagaaagcgaagaaaatgctgattatccacttcttctttaagtacttctattcctgacgcaaaagtccgttgttgttttctcaaataattgatagcaaatttaagatcagcctcatctatcgcctttcccactcccttatatttatcacttgccgtagttcctattacatcacactccagtaacagtttcccatagctgtcgtaaacacggctcttccgttctgtcctcccgttggtttccacccacatctttgaggcatatcgataagaagcttctgtagtatagttactttccccatgactaaacagtattgtatcaactacgctctgagcataagcttccggcatatcaggaacataagtcaatacctcaactggagctatgaaaccaatttttgattctctgtcaacctgatagcgacacacagtctcatgtactaatttttcatcaacaaggataagtgacttcacaacaggcgaaagaaaattggcttctttcatcataacaaagacagaatctgcagtgtctgccatatccatcgcacgcttcagaacttcagtccgttcaataccatcagagccaatacgaatgacacaggtgggatacatcgacatcggattatcataataatatttcgtccgagaatacggaatattttcgtcacttctgtattctacttcttcttttagagcagttctccagccatattgcagattgtagaacttgtcagtattagtaggagataatcgtggtttgatattatactcataaatctcttttcctgtaagatacgaagttccctgatttctataaaaagattccaaagacttcccatctaaataaaaatcagagggttgcatttgcggaagtttatcttcatagttgacatcagtttcataaatgtattgaattttctttagcatctctccattagtatcatacactgctttctccctcaacaaaccattctcccaatatggataatcagattcgttcactgacgtaggaggagatacttgataactatagacagtagaacccctaccggatatagtctccgtcacacatgaatagtaaagaccgttattacccatatttatcaccggataaccttcctgtatcactctgctatactcaatccagtccgtgcattctggataagagatactgacaacattagataaaggcttatacacactcacgcctactctcggataaccgtaagaaatggtatcactacgtccatttaattcgttactgaataccaatgacttcaaacgaattcctccgactataccctttctcccatagtttctttcatatttgacttcgattttccctccatccgataagactatatttttcagcgagttaagagtagcatatatctcataatctgtacactcttcatcctcatcctccgcataaggatatccccacaaatctactcctgtctccttccaaactggaaaatcagacttttcataataattgaattcaataccggatgttttcttgccgtttttatcacagaaagccaatcctctcgctaatgctcctcccgtggacgaaacagacgaaattagttccatatttcggttgtacaaactgatagcagataagctagaggaagacgaaaaataggcaaattttacaatatattcaggaaatacgattctgttgagcaatggagaatgaactttatagctttttcctccccatatctcttttgttttaacgtatttaacctcagataaacaggcgtatatatagtctgctgcttcctccaaatacgaaccagccatatccgcattaaatccgcctatacgtttacaatatgcagcgaaacctctcagactttctcccaattcttttgatacaccattcattttcgaaatgttggacaatacaccgacaattcgattgttagtttttatatattcactttgtagaggttgaatatttatccggctatatctttcaaaatcttttattttagagtccacatttttaaaatccagcaaaagagaacacatattcaaatagttttgggctacctcaatagcagaataaaaccgagatttatactggtcaaaatcaaacggttgttctttcacagattgaccatagtggtaaatcatcttatatgaatcatagattttcatagtatggatactatctaatgatagatttccaaaatctaaatccattacatcacctttatagcagaaatcaatcggtgctccattgtatggaagaatacgggtaagatgccatgccgaggtataaccggaatctgaaatagcattggaagtggaaacatccacatactcaacatctgcacatatttctctctgccggtagatataacggtcaccattattatctgtaatagtccagcctgttatctctgtggaagtcccttcacactcaatgcgaacatctgtctgtcccaacggcaaagcatatatctgtcttttttcattcatacggatgataaaatccaccttcttcccattgaacacgacagtaaaaatatcgctttccccatcccgtttacgaagccccacagtccttgcatcctgttccaatggagtaacagcattttctgtccacaggtagccgtaacctgatttctcatcggcaaatccaccacgcattgttcgggtaactataccaccaacgttaagtgtccaattttgacctattaaaccttcaggatcactcaccttcactccctttgcaatataatccaatgaaataggtaattcataatcacctgactttaattgatacagaggtacggtgtagtggaacaatcctgttgcatagtccaccgttacgttctttctttcggtcaggttctgggcttccggaccaggattgaaatcctgtgcctttccggatatagtcaccaataaaaaaataataatgtatatagtttttctttcataatcatttgtatttaatatctctagtttagtttttccgtttgccggatcgctaatcgataccggcaaacggatagtagctgccttacaaactcatcgcattagcccccaaaacgcctgctacagccgacgccaccgcgataaccacctttaggatcatatcccatactgatttcttcattgccatcatttacctcctttctcgttctttaaatagtttagtttactctgtgttcctaccgtattttcctccggagaaagcgtacgattcccctgcgtggcggaacaatgcaccacgatcaaattgatagttctcatgttaattgataattctctgtttagttgattgtcttattaaagtcctagtctttaaccaattatcattagttagtcttttgctggttatccttagttagctctagtttgtttcttgtttctttatttttctgttttacagttacagttcagtcgttagtcttatatttcttcccgcgaagcaagaaacaaattatactgtcgggtccggtgcttctccatcatctccgccatcgctgccaccaccaggcttgtcattcggatcatcaaccgatccgccgtcaccaggtgcggagaccagcttgtcatagcgagcacacttggcacccgtcaccatagaacgagtagcggtggtacgatccagattcttcgtcgtggtaggctggaagcggacggtaagcgtagcctgtgcagcactcacctcatcggcggtctcaacaccccggccacgggcactcatcaccatgcggaacgttcccaagccatccacactgacgctttcggacgactgaagatgctgcgccatcaccgtcaccagattgtcaagcgtattttttacatcacccggagaaagggaagaatatgcggcaatctctttggaaagctgtgcggaattgatatttcctgtacgaactacatggggataaaacagtttcttcccacttttcttatcttccagattagactggaaaggtttatataatactggcataattgtaatagtttttagttattaatctttttgttagtttctgtcgttaagcttattgacactgcaaatataagggcttattctcagctatacaagcgatttcggaaatgtgcgttaataagttagttaatataagaaataagcatataacatgtttacctttgcatcaccatttcataaggcttttatgaaagatacaagtaatgcggtagtagctcagttggtagagcattagcttcccaagctgggggtcgcgagttcgagcctcgtttaccgctcatttgaaaatcaggcagttatcttaaaatgactacctgatttttgtttatagaataagacgttaaacggtggttgaactgactaaagttcaaccaagagttcaaccaaaatttgtcatgaatgcaactattaacgtcgtatgttgtaagtggaagacgcttgcaaatggagaagtaccattaatgttacgtatctgtaaagatagtaagaagaagtatcagagtttgggaatttctattcctgttaagtattgggactttactagaaataggcttaaacctagttgcccaaatagagaatacattcaaaagataatcctcaataagcaggcagaacttcagcaacgaatgttagaattaaaatcagatgacagggagtataccgccaatatgcttcttctcaatgatacagataagacagttaaacataagacagttggtgagttctatcaggatttaataaaacaatatgcaaatgagagtaaatgtggcaatagactcatttataaatcttcatataattctctttataccttcactaaaggtaatttagatattccattcagcgcaattaacccttcatggctttgtaattatgagaaatggttacgttctaaaggtaacaaagagacaactatgagtttgatgttacgtactttacgtagtacatataataaagctattgagaataaatatgcacgtaaatcagactatccattcaatgaatacaagattggtaaatttgatgtcagcacagagaagagggctatagccaaagctgatataatgaagctgacagccgatatatcttctgttggtaagcgacaatacgtacaattaagtaaggatatattcatgtttagttatttatgtggtggaatcaattttactgatattgccaatttaacaagtaagaacattgttgacggcaaaaggttacattatatacggcagaagacaggtaagcttattaagttgggattatctgacgcagctttaagaataattgaacggtatgcccctgatagtcatggatatttatttcccattctaaatgtagaggtacataagacagcattgcagaaacagaatagaatccataagatattaagtaaggttaacagtaatcttaaattaatagctacacaatcaggacttgatattaacttaactacttatgtagctcgtcactcgtttgcgactgtattgaagaaatcaggagtaaatattgcattaataagtgaagcgttaggacattctgatttagcaacaacacaaatataccttgatagtttcgataacgaacagatagatgatgcaatgaagaacttattatagtaccttcaattaatcccacttgtaattattgcaggtgggattttatttatatatttgccctataaggagataaagccatgattaaagtaacatacgaagaccaattaaacatatctaccgaccttatagagtatttattagctctcatcaagattaccaataaaggttctgccttattacaggaacaagttgattattcaacagtctcacaaacaattgaagcaataagagagaatatttgtgaatgtgctcaaaaataccgaattgtaaaggaattgaatcctgacatctttaagaatctactcaactgttatgaccttcccgtttgtgaccacaaactaattcaactatgtgatttactgctactcttcaagagagcggaaagtgttaagtttgtgttagaaacgaatgaccgtcaaaccttaaaggctgatgagaagagcttcattgagaacgtcatacaagagaaactgtttcagtatctaaaagagaaacgtaagttagaagagtacacctcttttattatgtggacttccccaactcctcctaatagctttatctataaaaaggataagaatatctatacctatgctgctaataacccgcaacctgtctccattaacaagagtaatcttcaacagataagagacaaggaaatgatgatacttgaagataactccattgccgtagtcaatcatttatatcaaagattgatacagaggggattcgtcaaaccacttccttcacgtactcaagtagggacaaaacctgcctgctttatctatgacaccctcatgttcttagggtatttctccaatgattattccagttatgagaatcaatatcgaatcaacaaggctaagagagaccgtataaaggaactaataagacccaacaaataagataatacaccctgttttaaattggggggaaattaattcataatccaaatgaatcaccccaatctctccgcccttatattcagctttctaccgatatttgcatcgtaattcagagacaagcggtgcaccactctcgattacattatttattaactttaattaaattaagctttatggcaacatttaatttaaatggtttgggcacgcctaaaagtgcaacctacgataatgagagtgcgtatagagaattactctcaagagtgaataacggtgaatccattgtggttagtgtctacacggacaaagacaattatccggcattcggcatcgaaaccaagaaagtagcccgtttcaaggttagagtgaatcagtctcttcttagtctgcttgttggctaccttaataatagtacagtaaatgaggacacggtaagagcaaatgaggtagagcctaatgaagagggccaggacttcacaactgacctgttcaaacttctgattgatgaaggattcacaccccaaatcgctccactgttccgaaccgtttacggttatgtaaatgcggtgttcaacttccctaatggaagaatgtacttccgccttgaacataccgatgaactaatggactatttggcagataagaaactgctttaatcaaaccaaaggagagagtttaccggtagctctctcccctatttctcaaacctgtaattttaaagatatatcattatggtaactaaagctattaaactatataaaactaaaggcgacaagataccctatttgaccactattcttgaagagataccgaccgatacgattttatgtaaaactctgacaggattgggtgcgacttatggtgaaatcaaagccaaacgccattctataataattcaaccgaacgtatcgactatccaatgcaaatgcaatgaccccaagcatactcacgataatctgataggagtgattgataaggttggagtagatgatgtcaaggagtacattcttgcttccaaagataagtactgcaaattcctagtaacccccgaatcatttcataaggtaaagaaggcatttgaagaactggatatgtatatgtacagtgaatgcttcatgttgatagacgaatcacataaacttgtgaaggatgcggattacagagaaggcatttatctaccactggacgacttcttccaattcaaaggtaaagcactggtatctgccacacctcttgaactatcagacccacgattcaatgacttccagagattagtaattgaaccacagttctcctatgacaaggatatacacattcaatacaccaacaacacactggaacgattcaaggtaacagtaagggattcaaagaacgattgcatctgcgtattccttaattccacagatactatctatgctctcatggagaagacaggcatacttgaagaatcaacagtattctgtgcaaacaagagtgttcgaaaactaaagtactctcttaacttcaagaacgcctattcaaggtttgagcctaaacggatgaggaagtttaatttctttacaagtaggttttatgcaggtatggatatagaattggaatgtaaaccggatttaatcatgctgtccgatgtaaatttagttgaacacactgtattagacccttattctgatatgatacagatagttggcagattcagaaacggtgtcaattacattacacatataactaacacattcaccgattatacatatagaagtaaggaggaagtattgcgtgaagtggagatttatgaaatcaattataactttatacgaagagaactaggtaacgccattgataatggaagtcaatgtgcatttcgtactttgctaaagacctctccattcaatcaattcctagacagacacaataataaatcctattgtgcggttgataactatgtagatgaggtaatggtaagaaatatgtatttaagtgaagataccttatttacaacctataccgatgaagtgctgatgaagtatttctccgcatttagagcttcttatttatataaagcaggtaatattgaatggttacaacttcgtaatgctaataagtctattgtgtctaaacggaaggtgatagttgatatattggagaagattctaccttatgaaacggaatccgattacgagtttagaaaggacatttataaatctgaccctctgatagtggaagctgttgaaatcctgggtatcgaagaagtacgtagacttcgatatattacaaatgccttaaaattggaaatttataaggccaaatgtcaatcaccacaagtaacagaattaatacacgattacttcaaagttggcggtagatacttgttgaccgatattaagactacaatcaagcggatttatgaagaatgtggtatcgccccacaagaacgggtcacagcacagaccttacgtaactactttaactgtgaccgagccactcctaaaggtaaggaaggtttattaatagtcagtgtactcaattaataaggactggggaaatttggcagatgtccactttatagaccctccttcagaaataccagtctctcggaatcaactgtcttcatgtgttcataatgcaataataagtaactccaagccttatggatatggagttatttgcatttataagcatttccggtatcaccctcacgcaacagctatcttatcccccgaattcaaaaatataggtacttgaaattcataccccgacccttttcttgaggaagtgtttctatttagactttatgcagctatagagtgaaatatttaatttgtcagtgagcgcatcagatgtatatcgtgcgctaagcttctgtgaaactactaacacccccataccaaatcattaggaaaaagaaaggataacatgaattgctattcagcccacaaaccttttgaacttctgaaatgtgcggacttatcaatgatttgtatatgtctacatataaagatgcacaaaggaaagtgataagaaagaacttcatgtcaagccctcattttgtccttaaatacactatttactaatctattattatgcgtatggagaatttaaagattttattgacgtttgggataattctaattgtgccagtagtcttaatgccacagttctttattggattattaatactgattgtggcttgcttagctttcagacagagaaatttctaatattaacttaataaattacagattatggaatcaacattacagattatgccagtacaaagaactagtagaaactttggtgaatatgcagaagaagcggtaataattgaagagccaattattaagcagaaacgacctctattcattgaagccaatacgattgaagccagtttggaacatctaaggaatgattgcattataccagtattcgcaaaggacaatgaagctacattatctcatgtggctttcattgaagcggtacaggatgcaaccaatacattctttagcggtgaacaaattgaatcgccagatattcgtgtttctcatgtaatcaaaggtagaattcccgaagcaatacacaaacctgcaaatcagttactagagagtgacaagactatctactacgaaaggtgcgcttttgttattgaagttcctactatctatgagacagtacacggtaacaggctaacccttactattggtggtgtcagagcttataaccataccaacctttattcaaagaaaggtgcggagcggtttaaagtgtttattggctttacttgtaaggtttgcacaaatctatgtgtatctacagacggttatcttagttgcttggaagttaccaatacaagggatttatatcaagcggtattggaaatgttccacaaatacgatgcagccaaacacatacatttgatgcagtctttaggcaataccagtatgacggagcatcagttctgccaactacttggaagaatgagactttatcagtcattaccgcaaggctatcagaaagatatacctaaaatgttgcttactgatacacaggttaacaatgtggctagggcttatatcaatgatgagaactttggtagcttgggaaatgatttgtctatgtggaaactttacaacttgctcacaggggcaaataagagtagctatatagattcattcttggatagagcctataatgctacagaacttgcaacgggtatatgttccgctttacatggtgataacaaataccaatggtttcttagttaatggtatttgagaatacataggattgtcaaatactcaatatctgaaactatgaggagtttgttttatctacttgctgtgattgctacgttctttgtaagtgtgctattatatccagttatgataattggatatattctattgattggctattgtcttactaagagattatagtactactgaaagggtatctatatactatatataggtactctttctctattattagccagtagtataatattcacttctgttattagtgaatgtttagctaataatcagtaagttagatattccaactcaaaattaatattcacttttattagtttcactataaaacagaacgttatgtcacttaaatattcaagtacaacagcagattatctgcaatggagcgaagcaatgaacttaataagaaagttggcaagggatagtaattataagatgtcacttcttattgctttaggttgcttcacaggtctaagaatttctgatattcttgctttgaggtggaatcagatactagatgcagaagaatttaccattatagagattaagacaggaaagcaaaggacaattaggattaatatgcagctacagcaacatatcagagattgttatgagcatataaatccagttggtataaatgctcctgtattgataagtcagaaggggacagtgtacacagttcagagaatcaatgtcatgctgaaagagattaaaaagaaatacaagctacaaataggcaatttttcgtgtcattctcttagaaagacttttggcagacaggtttataatatgaacagtgataattcggagcttgcacttgttaagctcatggagttattcaatcattccagtgtatcaattactaaaagatacttgggattgaggcaagaggaattattaaatacttatgactgtcttagcttctgactaaacataagtaggatatattaagaggtttaaatacaaactcttaatgtcctacttataacctaatatgtctcacttcatcaacataaatatcatacaaattagttctttgattcaataatacatgaatatctaataaacgctcgggggctactataaactcatattcatttcttcccaataaacaagttactatatcagccttatgaactgtagccgcaagcactattcgtttacttctttctgaagtcaactcttcttccctaaatgcgaagaattccgcgaccttctgttcgggagtccaactaactccaaactctttactttcaaattcttcttcattagttcctctataaattgtaaattcttctgaaaattggttataataatccaattcctcattagtcattctatcagtcaatgaatatttactcaatatagaaactaatatctctagaacgagctaaagaaatatgttatattagtcctaatattataccatttatcattcgttttacactcatattttatctattttttcattcattattcattggtttcatactttcccgaactacaaatatacaacataaaaaagcatttgtcaagtcccaaacagattttaaccgcctgctttccgggaatatgaacgtctttgttatttttccggaatcacttcattcaggcaggctatagcgttgagagtacgtggatagccgatgtaaggcaaaagctgcgtcacgacagccagcaaagtatctttattattacctacattgacatttccctgtatgtgccctttcacctgtgattcacagcctcccaaggaaacaaggatggagaacgtcagtagttcccgtgtcttcacgtccagtccaccgcgtgtctggtagtctccgaagcagttggcggagagataacgctggatatgcttttggttttcgggagcatttttatgcatttggtcgatccgttcgccgaaaatggatttctgcaacgccagtcctttgtcgaaacgggtttcggcagaaacgaccgcttgtccctctaaaggaagacgtacaccgtgggcaagcagcgcctcattagtgatgccgacaaagtccatcactttagccatgcctgcataggctactgcctggtaaaggatttcctttatttctatcggagtaatacctgcattgagagcgctttcaagcatcatccggtattcggtctgtgcctgtgaggcaatattggatgccaatgttaccatgagccgggttttagtatccaggttgccgtattgctgcacctcctttgtgaaattgccgaatattgcatccagttcggggtcggtggcgcttaatccggttcctccgttatctttcgtagcttcggcatactgctggtcgtctacctgttccagccaaatattcttgttggtctgcggattgcagccgatagccagatgcgaaaaccaactatcgggggcggcaccgtgccaatgttctatgtccggtgctatttcaaccacatcaccggggagcaggcggcgtgccgctttgccacgttcctgataataccccacacccccgacagcaatgaggatttgtccgcccgtatggctgtgccagttatttcggcagccgggttcaaaagtaacgttggacatgggtacattcaagtctttattaccggtcagcggtgccagccaggattctcctgtaaaatattgcttgaatcccgtattttcctttcccaacggaaatgcgctgatgttctgaggtacttcttctttcttcatactctgtgcatttatagattgcatcggaatttgcagaaatccgatgactgttacaaaaataaaaaataattttctcatactgtgacgtccatggtttattatttaagaactctctgataatgcaaagttagctgttctgatccaactctttataatacaaattacggatataaaaaccaaaattacagatttatagtactgcctatcatttacttcatcttcagtccgggaatgagtggcgtagcatcaatcagttcgagcatctgcaccatatcaagtgtaccttctttgtacttcttaaaatgaggtgtggcaatatgactcttataggccgcttcatcggcatagatttcaagaatagtcacgtggttggggcgttctttctccgctacggcatacagtaccaatacgcccggttccaaccgcatcgagacttcgatctcctctttcagataagcattgtactcttccagccgttccggatcgattatgatgcgtgacaaccgcaccatattgttctcggcggcggatggttcgaccggtctgattacgtttgccgaagcggttgctgcaaacaatagaaaaataatcagtaacttcttcattttgctaatttattgtcgttcgaatttcactgccacattgcccggaacgttcaatgcatctattccgttaccgtcaatgcgcccaatctttatcaagtcattgctttgcgacccgcttttacagaagatcgccacattattccacggcacatagattgtaatatcaccgggcacaggtgcacagccacggggcactcctgccgtagtcagtgcaggcgacggatagaaaattttctctgtgatattattataatcattcagcgtcacttcaagcggcagacgtgaaagaaagtcctgcgccgcggcattgtcttccatcgtagcagtaatggtacggttaccgactgtaatcttcacattcgtagaagtagacggataattgttttcccgactcgcaccgagtgtttcgagccatgtccgtatccggtttcccatctgcgaaagtgtcgaagaagtcagaagcaatgtttcggtgaaagtggcaccggagcaaagtgtccgcgcctcgtcaactgatgcagagatgccgctgctgccactgctggcaaaaagagcgatacgcttacctgcaagtttcgaagcatgattatgcaggaatgtctgcatcggtgtggccatgctaccgtaccaaatcggatagccgacaaacacgatatcatagttgccgaaatcttcaaccgaagttttaatcgccggataattcccctgacggatagcagccagttcttcctgtgcacggttgagcatcccattataatcgctttcataaggtgtttgcggttccacttccaggatatcgcaatcgagtgtttgctgaatctgttgcgccatacgctccgtgctgccggtgcgcgaacagtaaagtaccagatatcgcccgttaccgcccggaatggggtttgtcgggtttgtagaatcgtcctcgtctccaccgtcggaatttcccggttgtcccggctgttccggaagaatcggatcagcgtttgagccgtcgcaagccgccatcggcatcatcgtcagcatcatcaatggaattaatagaatctttttcatattactatctcttttcaatgttaaattaccggttacaaagttacggggaatggtccagcccggatgtagacgatttacggatatttataccccaatcatggattttgatgggagagtaaaaattttaaagagaaaagaattatatttgtaacgcattaaaaaaacagattgtgatatggaagagaatactaaagaaatgattgtaatagacagcgttgaccgttacaacgaaatcttcgggcttgaaaccagacatccgttagtcagcatcatcgatctggccaaatccactacgtggcccacacgtgcgtggtttcgttacgaagtatatgcactatacttgaaaaatgtaaaatgtggtgatattaaatatgggcgccaatattacgactatcaagacggaaccattgtctgtttcgctcccggacaaatcaccgacctggaaatgctgccaaatattcaacccaacgcgcatggtattctttttcatcccgaccttatacgtggcactgcgctcggacaagaaataaagaaatactccttcttctcctacgaaaccaacgaagcactccacatttccgaagaagagcggcaaacagtgatggactgcctgcaaaaaatcaccatcgaactggaacattccatcgacaaacacagccgccgactaatctgcgccaacataggattgctgctcgactactgtatgcgcttttacgaacgccagttcgacacacgaaacggagtaaacaaagacatcattgtccgcttcgaacatctgctcaacgaatatttcgaaggagatgccccgcaaaaccaagggttgccatcggtcaagtacttcgctgataaagtattcctttccgctaactattttggcgatatggtgcgcaaacaaaccggtaaaaccgtctccgaatatatccaggataaaatgattgaactggcaaaagaacaactcatgtcttcgaacaagactatgagccaaattgcttacgaaatcggattccagtatccgcagcaccttagccggatgttcaaacggattgtggggatgacgccgaatcaattccgcttaacgggatattgccgttgatttcattttgttacgtttccggctaatcaacatcacccccagcagaatcaccagcaaaccggaaagctgaacgaaggtaacttgctcatttccaaaagatactcctaaaaggactgctataaaaggattgacataagcatgtgtacccacttctgccgccgggcgtactttcaagagccagacatacgccgaatatgccagtaaagaaccaaaagaaatcaaataaagcaaggagaaccagcttgtgaccgaaactgtactcaaatcggcttcccgaacatctccgttcacaacagcacaaatccagaacatcacactggcaaaaagcatttgccacgcagaacctgcaaaagcattcacttcttcctcacgggaagaacggtacttggcatacagtgttcccaaagcccaggatatacatccgaaaacaaggagcaagataccacgctcactttgcggatgcaaccattctgcattgagctgctccgcataaagcattactactccgccgaagccaatccctccgcctgctatcgtaaggggattgcggaaattagtacgccacatggggacatccaaaagtaaaatccaaagtgccgtagaagaagctataatagcaacgaggctacttgtcagatagcgctgtgccagcataacgacagccatatctacaaacaacagaacaataccgctaacggcagaacgctttaccaggcttttcttaaagatttgttctccccgtaaataacagattccaagaagtatcagccctgcagtcgtaaaccgcagtgctccgagcagaaaaggtgaaaaatctttcaaagccacccctataaaaaaataggtggagccccagactacataaatgaggaaataagcgatgataacacccggcaaattcctctttgagggattctgacttttcatatcacttctttttatttgtatttacggggagtgagaaggggaacctattaataaactgacaattattttattatttcaatgcccgcctcaatctgtttaatccttctatcaaccgctgtcgcggacacgcgatgttaatacggataaacctttcgccagcctctccatacagattgccttcgtttacccaaagcttttccttctccaacagagttttcactatatcctccgacgattgtttcaaagccgagcaatctacccatactaagtaggtaccttccaatggcagcaccggaaattcgggaagatattcatcaaagtaagcccttaaataatggtagttggcaaacaggtattggttaagttcttccagccattcttccccgtcattgtaagcagctatcaaggcttcaacgccaaacggatttacatcacagacttcattgatattgattgccttgtctatttgcattcgtatatccgtatcagcagaaacaatattggcaatctgaagccccgccaaattaaaggctttactaggcgaggtgcaagtaacggaatgcatcaaaaactcttctgagacagatgcaaaagggatataggtgtgtcccggaaagacaagttcgcaatgaatctcgtccgctactacccatatattattccgaagacagatttctcccaagcgagtcagttcctgctttgtccagactcttccggcaggattgtgcggattgcataatagcaggacttttacactcgggtcagccgccttccgttccaaatcgataaagtctatctgatacgttccgttcatgtaaatcaatggatttgcaacaacctcgcatccgttattgcggatggaggagaaaaagcagttatagacaggtgtctgcacgattactttatcaccgggagttgtcagcgccttgatgacagctgacagggccggtactactccggtcgtataaataatccattctttttcaatctgccagccatgacgtccggcaaaccatcttgttatcgcctcatagtaagcatcgggcacacgcacatatccgaagataccatgttccacccgccttttcagtgcttccaccacagagggagctgtacggaaatccatatcagctacccacattggtaatacatccgcatctccggcagaatcccatttataggaatttgtacctctgcgtggaacaatttcatcgaagttgtacttcatatatttcaatcaaaacaagtcagtccgtcccaaagtttcaattcgcagtttcccggagctttgaggttctcgtccaggatgattgtcccgaaactttcggcaacaatgtttcccgtacggggattcttcacgctgtgaaccgggcctttaatcgttgccttcacactactgtgttcgaaagcaagatcggcatcatccgccattgtgcagttttccattatcaggtcgtgtgcataacaaagtggctgcgtgcccgagatcttacaattcactaaacgtaagtttttagaatgccagcccaaatattcaccgtccaatacagaatcatatacagtcacattctccgtattccaaaatgcatccttcgaatggatttcagcatggcggatttctacgttcttgcaatattggaaggagtaattgccattcaatacaaaattcttgatgcggatgtcttccccatgtataaagagatagtctcctttatctatcttcacattgttcagttctacattccggcaataccagagtgtttccaaagcattgggcaactgtacattttcgagttcgactccgtccatttcgcgaaacatcttcggtgcttccactaatgtatccttcatcttcagatttctggaataccagagtgcggcacgtgctccttcggtaaaaaggcaatttttaactacaaaaccgtcattatgccaaaacggatattttccctcgaaacgacagtttaccgcttctatatcactgcactctttcagtgccgattcaccggcatgaatggttacttcttccaaataaagcccgtgggatgcgaacaaaggacgttcgccttcgtaatgtgtatttttaatttgtttcatgattcgattgtcttttatttaaatagttatctgtttttcctgttcatacttatttcttcagatattccttaaaaaaggattccaatttatcaaatggtataagccccacacggtcgtaaaggtctacatgacctgcaccgggtacaatgtacagttctttggggtcggcagccagtcggtaggcatcttcactaaattcgcgtgagtgggcattttctccggttataaaaagcataggacggggcgaaatagtctcaatatcttcgaaaggatagaaattcatgaatttcacgttgcttgaaagtgtagggtgtgtggtagttgtcagggttgctccttcgggagtaaactctcccctctgagtgcggtagaactcataaaattcgcgttctatcggaccagagttttctgttatttcatgtacagtgccgccagtatatttagtttctccgcccagaaattccgcatagcgctgttctgctgcctcagccatgatttgtttccgttgttccagagtcagcgcatgtttcagtccgttgcggctggctgtacccatgttgtacatgctgatggttgcaatcgctttcagacgagggtctatcttggccgcactgatagcgaaacttccgctgccacaaattccgattacacctatattatttcggtcgatgaacggacgtgtacccaaaaaatctactgcggcactgaaatcctccgcatatacctccggcaaaacagcattgcgcggctcaccttcacttccaccccagaaggataaatcaatggacagcgtaacgaaaccacgttccgccattttagtagcatacagattcgcactctgttccttgaccgctcccatcgggtgtccgacaatgatggcaggatatttctctccctctttcatggtcttcggcaaaaacaggttgccggctactttcattttatactggttagaaaaagaaaccttttctacctttacccaatcacttttataaaagttatccgcatcagcctgtgcgaaagaaaaactggttccaagcatcataataaatacaacggttaataataatattcgtttcatatctcttacatttaattattaatgaattgattgtctactttctacattacaaaaatacatataatgctattcatggagaaaaagaagcgtattaattagtaataaaacaacaaagtataaaagaatagatatctaattcatcacagttatgagaatattgaataaattgatttttgtagtgttactgccttttctgtttacggcctgccagtcctacaagaaagtaccttatttgcaggatacagaagtagtaaatcaaatagaacagaaagagaatttgtatgatgcaaagatcatgcctaaagatttgttgactatcgtagtttcctgtactagtccggagttggctgcaccatttaatttgacagttgccagtccaacaaatttgtctgttactaatattttagctactacacaacctgtgttacaaacttacttggtagataatgaaggaaagattttttttcctgtattgggagagttaaaactaggtggtttgacaaagaaacaggcagaacaaatggttgtagaaaagttgaaaccctatatgaaagaaacgcctatcgttacagtgcgtatggtaaattataaaatctcagtgataggtgaagtcactcgtccgggtacttttactatttctaatgaaaaagtcaatttattggaggcgcttgctatggcaggggatatgacggtgtatggcttgcgggataatgtaaaactgattcgtgaagatgccacaggtaagcaagaaattataactcttgatttgaataaatcagaaacaattctttctccatattattggctacagcaaaatgatgtcgtttatgtaacacctaataaggcaaaagctcgtaactcggatattgggaatagtacgagtctatggttctctgctacatctatcctagtttctcttgccagcttattatttaatatcttaaaataacgttttgaaaaaatgaaagaagaaatagtaaacgaaagacagtgtgaaactgaggacgagaaaatagatattcaacaattactttttaaatatattattcattggccgtggtttgtcggtgccgttttagtttgtcttattggagcttggatatatttgcgtatggccactcctgtttataatatatcggcaacagttttgataaaggatgacaaaaaaggtggcaatacaggaagtatggtaggactggaagaattagggttaagtggcttgattagttcttctcagaatatagataatgaacttgaagttttacgttcaaagactttagtgaaagaagtaatcaatctgttaaacttatatgtatcatatacagatgaagatggatttccttcaaagaatatgtataaaacttctcctgttttagttagtttgactccgcaagaagctgagaaactaactgatcctatggttgttgagatggcattgtatggagaaggtggtttggaggtaaatgttacagttggtgataaagaataccaaaagcattttgagaaattgccagctgtattcccgatggatgagggaactttagctttttttcaatcgccagattccttatcattgaagaaagatacaatggaagcgtcttcaaatatacggcatattacggctaagattaaatcacctatgaaagtagcacgggcgtattgtgaaaatttaaaaattgagcctacttctaaaacgacttcggtagctgtgatttcattgaagaactctagtttgcaacgtgggcaagattttatcaatcaattattagaaatgtataaccgtaatacgaataatgataaaaatgagattgctcaaaagactgctgaatttatagatgaacgtatcaatattatttccaaggagcttgggagtacagaggcaaatcttgagaattttaaacgtaatgccggtattaccgacttgactagtgaagcgcaaattgccttgaccggtaacgccgaatatgaaaagaagagagtagagaaccggacacaaatcagccttattgaagatttgcggaaatatataagaggaaatgaatacgaagttcttccgggtaatataggcttgcaagatccaggattggttgcaacgattgaacgatataatgaaatgttagttgaacggaagcgcttattacgtacttctacagaaaataatcctacgattatcaatctggatacaagcatccgtgccatgaagtcgaatgtgcaggcgacccttgacggatcattgaaaggtttattaattacaaaagctgatcttgaacgtgaagcaagccgtttttctcgtcgtattagtgatgctcccggacaagaacgtcagtttgtaagtattgcccgtcaacaggaaatcaaagccggactgtatttgatgcttttacaaaagcgtgaggagaacgccatagcattggcagctactgcaaacaatgcaaagatcattgatgaagctatcgctgatgatatccctgtttctcctaagcgtagaatgatttatctgatcgctttagtattaggcattggcatccccgtaggcatcatctacctgatcggcctgaccaagtttaaactcgaaggtcgtgcagatgtcgagaaactgacaactattcctatcgtcggtgatatcccattaaccgacgagaagaacgaaaaagacggttctattgccgtctttgagaatcagaacaacctgatgagcgagaccttccgaaacatccgtaccaaccttcagttcatgcttcagaatgacaagaaagtgattcttgtgacttctaccgtcagtggagaaggaaaatcatttatctccgccaatttagccatcagtctctctttattaggaaagaaagtagtaatcgtagggcttgatatccgcaaaccgggattgaataaagtcttccgtctttcgacgaaagagaaggggattaccttataccttgcaaacccggaaacagatttgatgagtctggtacaaccttcggatattaatcagaatctgtatatccttcccggtggaacggttcctcctaatccgaccgagctgttagcgcgtgatggtctggacaaggcaatagagatattgaagaagaactttgactatgtgattctggataccgcaccggtaggtatggttaccgataccttattgatcggtcgtgtagcggacttgtccgtctacgtatgccgtgccgactatacccataaagtagagtacacactgatcaacgaacttgccgaagaaaagaaactgcctaacctttgtactgtaatcaatggcgtagacctgaaacgcaggaagtatggctactactacggctacggtaagtatggcaagtactatggatatggcaaacgctatggctacggatacggttacggacaggaaaaaggtgctaaatcgtaatccggttctaagaataaacctgagaataaacgatagcccgtttcaatctgattgaccacagtatatcccccaagatatagtcagtcagatatagccgaccgcttgattttccccaatcaagcggtttgttgtattcatctacgttgacaatataatttttatatcccatatcaaagaaaagcgggtatccggacaaccagatgcccgttttttttgttatatttgtattatcccttaaaaaatgataattatgaaacaacactacagacttactatttggagccttttctttctgatcacttccagtggaagtgcctttgcccagagaaaaacgatcactccgatagactctctgataacggtaggatacgccaccggaagtttaaaaaccatatccggatcagtggagaaaatcacggagacacagatgaataaagaccagatcacgaatccgctggaagccatacgcggacgagtaccgggtctgaccatccagcgtgggacaaacggtcccgccgccttagatgcagtccgcctgcgaggaaccacctcattgaccagcggaaacgacccgctgattatcgtcgatggagtcttcggcgatttgagtatgcttacctccatttatcctacagacatagagagcttcaccatcctgaaagacgcttccgaaacggcacagtacggatcacgaggcgcctccggtgtcatcgaaatcaccaccaagaaggggatgagcggtaaaacgcaagtgagttataacggtattttcggtatatccaccgtctataagaatctgaaaatgctgtcagcagatgacttccgccgggtcgcatctgaacgtggcatctccatactggacaaaggaaacaacaccgacttccagaaagaaatagaacagacaggattgcaacagaaccaccacatcgccttttatggaggctcgaatgaatccagctaccgtgtatctctcggtttcatggaccgtcagggagtcatactgaacgaggacatgaagaacttcacctctaatatgaacatgacccaaaggatgttcgacggttttctgaactgcgaactgggcatgttcggttctatccagaagaatcacaatctggtagaccttcagaaaaccttctattctgccgccactttcaatcccacataccccaatcacaaagaccccgattccggttcatgggacggaatcactaccgccagtcagatcacgaatccgttggcatggatggaagtacaggatcatgacgccacctcgcatatcagtactcacgctcgtctgactttcaatctgatggacgaactgaaactggttctcttcggtgcttatacctataacataatcgaaaattcccaatacctgcccacctccgtctgggcgcacggacaggcatacaaaggcacgaaaaagatggaatccctcctgggtaacatgatgctgacctacaagaaaggctggaagaagcattacttcgacgcgctggcactggcggaactccagaaggagacatacaccggattctataccacagtcaccaacttcaatacagataaattcggctaccacaatctgcaagccggcgctctccgtccgtgggagggaaccaactcgtactacgagcaaccgcatctggcctccttcatgggacgcttcaactacacctatgccgaccgctacagtctgacaatgaccgcccgtaccgatgcctcctccaaattcggagccaatcacaaatggggattctttccctccgtctccgctgcatgggtgatcagtgaggaaaagttcatgaaacgcctccccgtgattgataatctgaagttccgtataggttacggtttggctggcaatcagagcggtatcgactcctacaccacgctgagccttgtcaaaccgaacggagtgattcccgtaggaaactcggcagccgtgtcattgggagacttgcgaaacacgaatcccgacttgaaatgggaagtgaaacataccttcaatacaggtattgaccttgccatgttcggcaaccgcctgctgctctccgccaattattacaactccaaaacgacggatatgctctacctctacaacgtaagcgtaccgccctttacctacaacaccctgttggcgaatatcggctccatgcgcaacagcggtctggagatagccatcggcatcaccccgttgaagactcaggacatggaactgaacatcaacgccaacatcaccttccagcagaacaagttgctttctctgagcggtatgtacaatggcgaactgatttccgcccccgaatacaagagtctcgccagcctcgacggagccggctttcacggaggttataaccacatcgtttatcaagtagtaggccagccgctgggtgtcttctacctgccacgtgccaacggactcgtttccgacggaaacggcggctacacctatgacatagccgacctcaatggcggcggcgtcagcctcgaagatggcgaagaccgctatgtagccgggcaagccgtaccaaaaacgattctcggatcgaacctcagtttccgctacaagcgtttcgatatttcagtacagatcaacggcgccttcggacacaaaatatacaacggaacctccctgacctatatgaacatgaatatattccccgactacaatgtgatgcaggaagctcccgcacgcaatatcaaagaccagaccgccaccgactactggctggaaaacggagcgtatgtcaatttcgactacgtgacactcggctggaacgtaccgatagaaaaggtgcagaaactaaagaaatatgttcgctccctgcgactggcatttacagtcaacaaccttgcgacgatttccggctattcaggtctttcgcccatgatcaacagttcgacggtcaactccactttggggctggacgataaacgcggatatccgttagcgcggacttacacgttgggattgagtattaacttttaacggaggaggaaaacaataatgaaaaagataaagcgatatttgcagcagcaaggatggtatttagagagtaaatctctatatgatggaaaagcaactctgcttggggggaatctgcttgaggggaagatgaacctgaaaaaaacagttgtctttcttattgtgtgcattaccttcttctcgtgcgacaagtttctggaagagagtcccaaagacaaactgccggaagatgaagtctacaacaatatctcggatgtatatctgaatgccgtagcctcactttacacctacatcggcggttatagcgacagtcagggattgcaggggacgggtaggggagtctatgacctgaacaccttcaccaccgacgaagccattatccccacccgtggcggtgattggtacgacggcggcttttggcaaggtctgttcctgcaccaatggggaatagaaaacgatgccatccaagccacttgggaatatctttataaagtggtgatgctgtccaacaaatccctcgaacgaatagacaaattcagtgctacccacgcagacgccgaacttcccgcctatcgtgccgaagtacgcgccatgcgggcgatgtattactattatctgatggatctgttcggacgtgtcccgcttatacttacctcatccccatcgatgaaagacgtagtgcagagcgaacggaaaacgatattcgactttgtattcaaagaactgcaagaatccgcccctttgctgaccgaagtccacagcaaccagtccggtccgtattacggacgaatcacccgtcccgtagttgttttcctcttggcaaagcttgccttgaatgccgaagtctatgccgacaacgactggacggacggccagcgtcccgacggaaagaatctctttttcgaagtagacggcaaccgcctcaatgcctggcagacggttatcgcttactgtgaccaactgcaagaaatgggctatcgtctggaaccggattacaaaaacaactttgccgtattcaacgaaccgtctgttgagaatatcttcaccatcccgatgaacaagaccttgtacaccaaccagatgcaataccttttccgttcccgccattacaatcacgccaaagcctacggactgagcggtgaaaacggaccgagcgctactatcgaagttctggaaaccttcggctatgaaacagcgcaacaggacccgcgtttcgatatctgctattttgccggagtcgtatatgatttaaaaggaaatatagtccgtctggacgatggaaccgttctcgaatatttgccgtggaaagtcgaactggatatctcgaatactccctatgagcagacggcaggagcacgcatgaaaaagtacgaagtagacgaaacggctaccaaggacggtaaactgatggagaacgacattgtactgttccgttatgcagatgtcctgttgatgaagagcgaagcaaaggttcgtaatggggaagacggagatgccgaactgaacgaagtacgcgggcgtgtcaacgcttcctcccgaacggctacattagaaaatatccttgccgaacgacagctcgaactggcttgggaaggttggcgacggcaggatctgattcgcttcggagcgttcacgagagcatacagcagtcgtccgcaacttcctgctgagaataatggatataccaccgtattcccgattccggaaaagatacgggtaatgaatacaaaactggaacagaatccgggatattagctggtttcatccatttataatatccaatacaaactaaaagagtgtgtgtcaagccaatagtaactaaaatggggtgactattgacttttgacacatttacatttgcagtattaaatatcacaacaaaatataagtgtatatttgaaaagtagagttgcagtgaactaactttgacactagtcttaaatgactataggctgaatcagacaaattattctttattagtagtaaacttgcttttatcaagaagataagttacctttgtttaatagtaaactataaatgcaaattccaattatacaaatgcaagttgcaactttaaaaacgcaacttgcatttataaaaacaaaagcatcaattatagtttataattaaccaataagaactttagtattggaagaaaggaactttacctctaataccaaagaatttatctattaatactttagaaccaagacagtatggcacgatacattatggaagagatgcccgacattcagaaaacgggcaaaagaattacttatcccaagtttgcacggatagacaatgcaagcattaaggaactggcgcaacgagtaggagacgtcagcggcttcagtgccggagacatagaaggcgtattgctccagaccgccatagaaatggcgcatctgatggcggaaggacgctctgtgaaaatagacggaatagggacttttaccccctcactcgccctatgcagagacaaagaacgagaagaggcggaagaaggcgccaaacaccgaaacgcacaaagcatctgtgtaggaggagtgaattttcgggcagacagaacgatgatcagaaacattaatgaaagatgccggctggaaagagctccatggaaaccacaacgctcctctaaaaagttcacaccggagcaacggctgacattagccctgaaatttctcgacgaacacgctttcctgactgtacggaattaccaaagactaaccggactgcttcagacagctgctactaaagagctgaaacaatgggctgatcttccggaatccggtattgatattgcaggaagaggttcgcacagagtctatgtaaagaagaaagttgccactgaataaaaaataatatatgatgagagataccctgaaaatagatgagagataactaaaaatgaatgagagataactgtttttaggcgtattttcactataaaatgatgagagataggttcttgcagaagtatctctcattcgataagaatcttattatctgatatttaagaaaaaacaatgagagcaatgagagataaaatctttttttctttttctgtagaaggtaagattcgaatgaaaaagcagcgattatgaccgaattggaaaataaacgcacaaaaatggaataatcatcttaaaagaactatctttgatatttgattgtttgaggagctagaatctgaaaaacaaaaagaagcaaactttatagttatggaaacagtgaaacaaataccatatggcatgtccaactttgaggacgtaatcatgcaaaaccgctattacgtggataaaacaatgtatattcccttattggaagatcaagccaactacctgatattcattcgtcctcgacgtttcggcaagagtctgctgcttagtatgctccggtcatactatgacctttcacaaaaagataagttccagcaactattcggcaatctctggatcggtcagcatacaactccgcttcaaggcaaataccaaatactttatcttgacttttccaaaatcggtggcagtattgatgaactgccacaaagattcgattcttacagcgctgtgcagctagacggttttctcaaccgatatcgtgaatattacacagatgaattcatagaacgtttcagtgctgcggataaaggaattgataaacttcacatccttgatgacgaagccaggagattaggttatcccctatatcttattatagatgaatacgataacttcaccaatgtcgtcctcaacgaaaaaggcaacgaaatatatcgtgccatcacccacgcaagcggcttctaccgtgatgccttcaaaaactataaaggaatgttcgaccgtatctttatgatcggtgtcagtcccgtaacgctagacgacttgtcgagcggttataatatcggttggaacatcagtaccagtccggtatttaaccagatgctgggattttctgaaaaagatgtgcgcactatgttccaatattacaaggaaacagggcaactgcatggagatattgaagagatgattctggaaatgaagccgtggtatgacaattattgttttgcacgtcaaagcctgagttctgatcccaaaatgttcaactgcgatatggtactttactaccttcggaatcggattcagttgggagcatctcccgaacagatgattgaccctaatacccgaacggattataacaagatgaaaaaactcatccaactggatcgtcttgacggtaatcgcaaaggcgttatcaaacgcattgccgaagaaggaaaaatcatcactaacctattccagtctttttccgcagaccagattacgaatccggaaatatttcccagcctgcttttttactatggcatgctgactatcatcggaacacgtggaaatctgactatcttaggaatccctaatacaaatgtccgaaaacaatattatgaatatatcttggaagaatatcaaaaccaccactatatcaatctgatagatatagagatactcttcaataacatggcttttgacggtgaatggcgacctgcattggaatttatagccaaagcttataaagagaattcttccgtgcgcagcagcattgaaggagaacgcaatattcaaggattcttcactgcctatcttagcgtcaatgcatattacttgacgacacctgaggtagagttgaaccatggcttttgcgacatgtttctcatgcctgacctgcaacgctatgcagaaattgcacacagctatatagtagaactaaaatatctgcctaaagaaaagtttgatgcccagtctgccgaacaatgggaagaagcggtggctcaaattcatggttatgccgcaagtccgaaagtccgtctattatgccaaggcacgcaacttcactgcatcgtaatacagttctgcggttgggagatggttcgtatggaagaagtctgacctacaagttcttgctatgatgccccgcaaagcgcataaaaacttgagataatcctccctcctgcccttgtagctgcacaaaattaaattcgcgcaacattggcatcccttttatctcaactacccgtaaagtgccggccacaagttctttatgcaccgaccggatagaaacaattcccatacaatcagtatgttccaaaaagagcttgatactctccgtaccaccaagatacatcagaacattcaaagaagacagcttcagattgtgttgcgacagggctcgttcaaatacatccaacgtccccgaacctctttcacgcaaaaccaaagggatattcggcaattctgcaggtgttatctcctcctgaatatttagtttactgttcacatgcactaccgcaacaagttcatcttgcaaaaacaaagtatatttcagattaggtaaacgaaaaataccttccaccaatcccaattcaatccggtgttcttgcaaagcgacctccactccccgagagtttccattaaggacggaaagattgacttgtggaaacttcgcaataaaatgagccaataaagggggcagaacatattgagcaatcgtcgtgctagctcccagtttcaactctccaatatactcgttatgcaacaaatgcatttcatattcaagccgcttgtaatcatctaaaatcttttcgctatgcttcagtagtaattcaccggcaacagtcaatgagattttactcccctgacgttcgaacaaacgagcctgataataagtctccaattcctgaatatgcttagtgatagcaggctggctgacaaacaattcttgcgaagcctttgtgaaactcagattcttcgctacgctctgaaatacttttaaacgaaaatcggacacctttttatttaagttatttgaggattaaaattaaagatcaggaattaaacacaaagactatagttcttcagctttgattcctaatgcttgcataatagggaatgccaacatatcccacttatattctacctgcacttcaggctcattcatacgaaactggataatctccttgcctttcacttcatgcaacgcatcgaatactttctttccatattcttcattgaaagaaacgacaatcatccttttcacatcagccgaatcagcaacgatagacaataaatccaaaaacaaatcttcgcgtgaaaccatcccttccgaaggaacacttgcaaacgaatattcaccataaggactctgaaaagcgactccattcaactccttcaccaaatcggaaggatggcaatgtacaagctgatcggactccttatcgtaaacaaaaagaaattgtacttcatttttcccttccgtgattccggcatccaaagtcagataagtggtcaacatagaaaggtcgatatcctgtaaagaacgtcgcaaagtctcttcaaagtaacctttcatatctgtaattacaaaattcaagaaagcagcatcaatcaacactactgtttcagacagttttatttgaggtttatcattcataccttatttataatatgattacagcggataaagatactacaatacttttatttattcacttcatttcgcggcaaattcgtcagtatcattcagatgaaaaaggtcattttgtcttctaactcctttataatcatgttattttgtcatatttttctacttggcaaatcttttgagccccttcaagtgttattaaaatcatgaaaaaagaaaggagaacaaccatatgaactttaacaattttaccatcaaatctcaagaagcggtacaggaggccgtaaatctcgtacaaagtcggggacaacaggcgattgaacctgctcatatcctacatggagtaatgaaggtaggcgaaaatgtgactaacttcatctttcaaaaattaggaatgaacgggcaacaggtagctctagtcgttgacaaacagatcgaatctctgcctaaagtatccggaggagaaccttacctaagcagagaatctaatgaagtattgcagaaggcaacccagtattctaaagaaatgggagatgaatttgtttcattagaacatattctactggctttgctaactgtgaaaagtaccgtatccaccatcttgaaagatgccggaatgacggaaaaagaattgcgtaacgctatcaatgaactcagaaaaggagaaaaagttacttctcaatccagtgaagacaactatcagtcattggagaaatacgctatcaatctgaacgaagccgcccgcagcggcaaactggaccctgtaatcggacgtgacgaagaaatccgacgggtactgcaaatattaagccgccgaaccaagaacaatccgatcttgattggtgaaccgggtacaggtaagacagctatcgtagaaggattggcgcatcgtatcctccggggagacgtacccgaaaacctgaaaaacaaacaggtctactctctcgatatgggagcattggttgcaggagcaaaatataaaggagaattcgaagagcgactaaaatcagtagtcaatgaggttaagaaatcagaaggtgatataatcttgtttattgatgagattcatacactggtaggcgccggcaaaggcgaaggagcaatggatgctgcaaatattctgaaaccggcattggcacgtggagaactacgttcgatcggtgcaaccactctcgacgaatatcagaagtatttcgagaaagataaagcattggaacgtcgtttccagattgtacaggtagatgaaccggatactctgagtaccatttccatccttcgtggattgaaagaacgctacgagaaccatcatcatgtacgtatcaaagacgatgccatcatagcagctgtagaactgagcagccgttacatcactgaccgtttcttgccggacaaagcaatcgacctgatggatgaagcagcagccaaactacgtatggaagtagattccgttccagaagaattggatgaaatctcacgtaagatcaaacagttagaaatcgaacgtgaagccattaagcgtgaaaatgataagccgaaactggaaattatcggcaaagaactggccgaactaaaagaagttgagaagtccttcaaagctaaatggcaaagtgaaaaaacgctgatggataaaatccagcaaaacaaagtggaaatagagaatctgaagttcgaggcagagaaagcggaacgtgaaggagactatggaaaagttgccgaaatccgttacggaaagctccaggctttggacaaagagatagaagatacgcaggagaaacttcgtggtatgcaaggtgataaagccatgatcaaagaagaagtggatgctgaagacatcgctgacgttgtttcacgctggacgggcatccctgtcagcaaaatgatgcaaagtgagaaagataaattattgcatttggaagacgaactccatcaacgagtgattggacaggacgaagcaattgaagcggttgcagatgccgtacgtcgtagccgtgccggattacaggatcccaaacgcccgatcggttcttttattttccttggaacgaccggtgtcggtaaaactgaactggcaaaggcattggcggaattcctctttgacgatgaatcgatgatgacacgtatagatatgagcgagtatcaagaaaagcatagtgtttctcgtttggtcggagcacctccgggatacgttggatacgatgaaggcggccagctgacagaagccattcgccggaaaccttactcagttgttttgtttgacgaaatagaaaaagcgcatccggatgttttcaatatcctgttgcaagtactggatgacggacgactcactgacaacaaaggaagagtagtcaacttcaaaaacaccatcatcatcatgacttcaaatatgggaagttcttatatacaaagtcagatggagaaactgagcggttcaaataaggaagaagttatcgaagaaacgaagaaggaagtgatgaatatgctaaagaaaaacattcgtccggaattcctgaatcgtattgatgaaacaatcatgttcctgccgctgacggaaactgaaatcagacaaattgtactcttacaaatcaaaggtgtacaaaagatgcttgcagaaaacggagttgaactggaaatgacagatgctgctttgaatttcttatcccaggtaggatatgatcctgaatttggagcccgtccggtaaaaagagctatccagcgttatttactgaacgatctgtcgaaaaagttattgtctcaggaagtcgacagaagcaaagcaatcattgttgactcaaacggagacggattagtattcagaaactaaattatagttagttgttataaggacagccggtatgttcccaagtgagcatatcggcttttttatattcctgaatatataattcttcttacttccggctgacaattaggatggctcatgactaagacataagtaccttttctggatatctccaaagtgagtgaaggcaaggcaaatctatgtttctctttcagctccccctgcgaatcatataaaaataccattgtacctaccaacattcctgttaagcacaatgttcctttttcattatcaagataaacgtttacctctttatttgttattacatccatattttgtgcgtatattagcagtcacaaagatagagaaaaactatgtttatttactatataaataataaaatattcatgcaaacataagattgcttaaagaacactaaaggggatcctttaattacgcagacatataaaaacacaaaaaagcgtgacaacttgcaacattgtcacgctttccttattacatttatacatctaagccatcaatgtttcatgacttatttttcatcagtcgcaacctcttcttcagcttccggctctgatttaaattctgtaattccattcgaaattaagatgttataccaggaaatcaatttcttaatatccgcaacgtatactctttcacgatcaaagttaggcaatacctcccctaaatactcgcgtaactgctccggagtagcttttttagggtcaatggaggtgactgcagtattttcttttttcttcatagcttccagcacatcatacaaaggtacttcagcatcatctgtatacattgctatatctgccaaagagataattttctcattaccataagcggggaaacgttttttatctgcactgattgattcaacaatcaacatattttttccttgcgaaattagtttgtacaatcccggtttaccggagatagacaggatagtcttcaacatagtatatattccatgaaggctagcattgatattagtaccccggtgaatagatattttattttcataatttttctcttattaaataattattatttccacagttcattttgttcacagagtgtgttgtcttgaagttctgtgtatggaatagggaaaattgtatatttttcagggaataaacggtcttgtgtatcgcattctactcgtgcgtaactgaaactgccaccggcctgtgttatcttaacgccgtgcagacgtttatgatcaagtgttcttacggcgattccccaacggatcaggtcgaaatatcggtgtccttccattccaagttcacaaatacgttctttagacagatcttccagataatcactccaattattttgttgggcgagttccggcagtccgacgcggtcacggatcgttttcagatcagcataggcttttccaaactcgttttgtcgtgcatatgcttccgaacgaatcaagtaaatttcagctaaacgcatttctatccagtattgtccactcaaaatgctgctaaagttgatattggtatcatcagaagcgaacttacgaatcagataacctgttgttgatttgtgcacattatcttgtccggttgtagcaaaatccatatatccgtcatttccatctacatacaactggagagtacgtcctttccatgttgctccattataaagaatggaggcgtaaaaacgtggttcgcgattggtaaatggagcattgttgtaggaactgagattactccagtcaaaagattggtagctaccgtttactttgatatcgaaagaggaagcgtattcatcagatggagtgactgccgcacctacacttccttctgtaacaccggctgctttccagtcgtatggtggacacacgtagatgtcaaaagaatgttgcttggcgttctttccctgttggaagtaaaccggaaggattagctcactattattgactgaggtgaatattttgtagtaatcattggcagtcgttccttgcaataaactgtaattcaattttaatacttcattgcaggcatctatcgcatccccccagcgtttagcataaagggccgcacgtgctttcattccgtaagcggctcctttggtaatacgccccacattggtacctgtccagttttccggaaggtcttgtactgcctgggtgtattcgttgataatgaaatcccagcaatctgattcagatgaacgtgctttagctctttcgtcaggtccgtctacataatcttcatcagtacgcaggataactccgccatgacggagcaccagttcctggtaagcaaatgcacgtaagaaacgaacctctgctgtacgctttttcatttcatcctgatctaagttatctccataacctttgcttcggtcatagaaatattcgttgagttgacggatacgggtatacataccactccagttggagcggaagttgctcgtttcggtgacataattcgtctgataaaagaatttattcatggcacctccgttcactccataccaagagtattttaacagatctgtagctccatcgtccattaagcagtaagaatctatattgatagtagcattatcatatagcacgctatatagccctttgacgtaaaggtctacattttccagtgaggaatatgctacattctcgctgtaccagccagtaggatctacgtccagtacatcacattgtgtcaagcaaatgctagctgctatgcctataatgtatttttttatatttttcatattaactatttgttttaaaatctaacatctataccaaaactgaatgtacgttgttgtggataatatcctgttgctacatttgtactttccgggtcgatatacttgaaatcggtaaatgtcagtaggttagtcccgttagcataaactctgatgtttgacaatcccatcttgttggtccaggctttaggaagcgtatatcctaaagtcacgttcttcaaacgtaaatacgcaccatttcttttccagaaatccgattgttgggcattgtttgaatgagatacactgctgacagtcagacgaggatattccgcatttgtatgatcgggtcgccaactgttttctaccagataaagaggagcgttgtcccaatttgcataccagggtcttgtcataggggtcatatctgttgcgccatttaagtcttgccatgagtattgaagcattttatcacaaagtgccgctccttgaaactgaacagataaatcgaagcctttgtaattagcgtcagccattagtgcaaacatcatttccgggcggatgccacgtgatattttgattcggtcgttggaatcgatctttccatcgccgttaatatcggcatatttaatgtctcctactcgtggtgtattccatgatacttgaggtgaattggcaatctcttcttcactctgatacaaccctaatgcttttaatccccataattcaccgactgatgatccgagaacactttgccagggtaatgtgttatccgcctgtgttctgcttaagatacggttatgagcgtaagataagttgccattcaaactataactgaattctcctatacgattgcgatgtttcagtgcaatttcaaatccgcggttatcaaatgttcctgtattttcagaacttgggtagtgtccacctaaagaaggaggatagatattactaacactttgaagaatgtcgtatgtatatttgtagaatacatcaaactcaactcccaacaaaccgttccaggcactaagatcgaaacctaagttatatgattttgttttttcccaagtcagtcgttcatttggataagctactgtgttgctaagtgttccttgagtgttaggtgtactgccaaatactactccattattagtataagagtaggattttctgtacaagaaagcactaacgttgtcgctacctagaataccaaacgaacctctgagtttaaaatagtctattttaggaagtgcgtctttgaaaaagtcttcttccgacatcacccatcctaaagaaactgaagggaagaatccccaacggtgtcctttggcaaacttataagaaccgtcgtaacggaaagatgcttcggccaggtatttattggcgtaggcataatttagacgacctacataagcggcgtaagcacttttcccagaagaaccgctattagttgcagtttgggcatctcccaaagatatttcgggtaaatcgaataagtcgtaatccgtacgactagcattcagtgcagagctttttacctgagtttgttcgtagaggaaaagggctcctacatcatgaagtccgaatttgttgttatatgaaatagtcggacgtaatattacttgttgtgatttttggtcaccctgatataggttaccatctgccagcagatttgcactttgtacatagctgtagcttttggtggaagaatcataggcattgacagaatatgcataagcaaatgttttacttgccaggtcttgccagtcccaactgatgaacatatttgctttcaaacctttcaggaatggggctgtatattcgacatttgcggaactttctattctgactctgcgagattcctggaatcctgaatttgcagatccatagatcggattggctgcgctggttgcgcctcggtatgccgaagtaggataaccttcatactctttcggaacaaaaggtatagagtaaagcaactgatggaaaatactataggcttgttgattgccataagagtatcctcccggctgataataatctttgattaatgctgcggtatttagtgacactttaatgtctttggtcgcttgtacatcaatatttgaacggaaattgctgcgttcgtttttgttgcctttaataataccatcttgatgtaaatagccgccgctgatgaaatatctgaccttattgctgcctccgtttatagacagattgtgttggtgcataagggtagtcttatataagtcggaggtccagtctgtattttcaaatccatcggtagggtctccgttataagttgccgcaatttcttcgtcggtaaaatatggattatctacgccattattgtctagtttgcgagccagattataccattgcatatattgggttccgttcatcattttaggcagagtggtagcgtgcgatagagtcatactgcctctgtaggtgatatctgttttaccttcttgcccatgtttggttgttaccagcacaactccgttggctgccttcataccataaacggcacaagatgcagcgtcttttaggatggtaacagactccacgtcattcgggtctacttgtcccatagctcgttctactccatcaactaaaacaagtaccgtacctgaaccgctgaatgaagaataaccacggattaatatggaaacatcatccgatcctggttgtccgagtgattgttgggtaataaggccgggcaacttaccgactaatgtttgtgacatattactggcagttgttttcaacatatctttttgagataccgtggctacagatccggttaagtgagctttcttttgtgttccataacctactactacaacttcgtccaaattagcgacatcttcttttaagatgatgttgatcgtactgcgtccgttcacttttatctcttgtttgttcataccgatgtatgagaattcaagagtggcagtgttggatgcattgatagagtatctaccgtcaatatcggtagtggtacctgtggtcgtacctttgacaacgacgctgactcctggcaacggatcaccggtcacgtctgtgacgactcccctaaccatgttctgggcatagccatttgtggcatacgcaaaaagcatcgacaatgagaatagtatgattctgattgttcggaaactacttttttgcttaaagcattgttccatcataagataaaatttaattggttaataaaaaagtttttgggtattagatttattgtaattcttctagtactttccagcattgatataagcccctggggacatggaaacagcctttccatttgcctcctttaagtggcagaagtacttctccctggcggtttaagtaaccgaaccattcaggatattgagcatctttgaagtgcgtccatacatactcatgtattttctcgaaccactccatacattgtttgtcacctgtcaattggtaaccttttagtagggaaataagtgtttcaatgtgtacccaccaaagtttttggtcccattccagttgttggggagggcaacctttgcggtccataaaatagtagatgccaccatattctttgtcccatccgtagttaatcatcgtcaaggttacattttttgccttttcgattagatcagggcgattcaggcgttttcctaaatccatgataaaccacatcgcttcgatgtcgtgtccgggagtcacttgccgtccttcaaaacagtctacgagattgccgtccactcctatgttttcaacaataattcctcctagctccgggcgatagaatacttccatcacttcatggatacaagtctctattgttttttccagatactctttgtccaacaagtgttctatttcaagtgccagattacaaaggatcatcgggagggcgaaatttttcagattacgtgtgcccggatggattttgttccatttacctttcggattatctgcctttgagagaataatatcgaacgttttctttgcaatgtcagcatattcctgattgcctgtagccagactgagttgcccgaaagccattgtagcaaatgtataggaaaagatgttgtatggttctaccagaggattacctgcccgatccaaagaaaaataccaatgatagtttccatcatgtccgtatttctttagaaattcactgccttgaatagcgcaatccagccattcctgttttttctcaactttattgtaaagcattgagaataaccaaacttcgcgtccttgcagccaaataaatttatctgtatcgaatacgttgccttcacgatccagacaagtgaaatagccaccgaattcgtgatcctgagaatgctctaaccagaatggaagaacattattcagtagttcgtctttgtattggtttgctaatttttttaaatccataattgttagttttttatttaataaggtctattttaccgttccgaacgggtccagtatctttcaatctcctccagagactttccggtagtttccggtacgagtttccagacaatgagcatatacggtacacacatgatggcgaacaggaagaatgttccggctggagtaagattctggagcatccagggggttagctgtccgatcagataggtaccgatccaaagagcgaatccggcaatggacattgctaatccgcgtattttggtagggtacatctcagagagaagtacgaatatcacagcgcaaatggaaatggcgcaacaaaaaacataacacagaaagaaggctaacagaaacaggctggaaatattccaggcatttccgaagaggaaataactgccaatgagtatcaatgaaacgaccattccggataccccataatatatcagtttcttgcgtcctactttgtcaatgatgagaagtgccaggatagtggtcagtgtattcacaagtcctacaagaacctgatagaacagagaatcccctcctgaaagaccggcattctcaaaaatggaaggcccgtagtaaagaactgcattaacccccatgaactgtcccagaatagcaatacatacaccgataatgactgctttcagaatacctggtttcagaaggatagaccattctgaacgggtctcggaaacaaggacggattttgtctcgtttagctggaaatcagcctctttaaatgaattgtagatcttttccagaatataagtggctttcctttcttgtccttttactatcagccatctggggctttcgggtatgaaaaagataataataaagaatattatggctggtaatgtctccatgcctaacatacctctccacacttctgtaactactattttttctaaccaggcgataggtaagtggtttccactctctgaatatgccaataactggtagttgacaagataagctcctagaaaaccgacagttacggccagttgatacagggagaccatcctgcctctgaattgtgcgacggaaacttcggaaatgtaaagaggagatacaatagaaacaacaccaattccgatgccacctatgattctataaacaactaactggttaaagtcaatgcaaaaagcacagccgattgctgatgtagaaaacagaatggcagaaagtatcattgttcttttacgtccgatgctgtcgctcaatattccggaaaagagaacaccgacaatcgatccgatcaatgcgcatcctacataccatccttgttgcaaggtgtccaactgaaacagatgtgtcacctgagctattgtgccggatatgacagctgtgtcataaccgaacagaaagcctcctaaagcagcaacgactgaaaggaatatgatataacccagattaattgttgttttcatatagtttatttgatttcaaagtattctctgtatctgtcatataaatgtcctgcctgcagataagctgattgcggacttaaaaagtgagaaaactcaaaagtgattgctttatcatatccggcacgttttgccgcttccagtttcatgcggagtttgtcgaatttgatcggcaggaaccggatgggcatatcgcggtcgaatgtttccgcgtttgtccaacattgcattccgtatttgtctgccagtttcttgtttacagtgaaaaaagcatccagttcgtcgtagtcaatgtgtccgtcttgaaaagcacaagcgtctactacatcgtgtataccatcaaaaatttcattccattctctctcatgttgttctacggatacagcatcctcccttgtcatttttccggttcccatgactgcctttttaccatcaatccaaggggatataaaagtagggaggccattcgatacatctttgcattgtttacccatggtatgaaatgcaccgatagctcctttggtattgcggctgatttccgtgctaatataccagcctccgaaactcttatacttttcaccgtaagtattccatacttcgtcaatcacatatttattatattccacttcccacgacatatcacgtgtatcccaataatgaccggtgtcatacagcccaaaataaaacttcatgttatatttttcagccagtcgtaagtacatatctactaaatccacggaaggcatatagcatccttttcctaatagatatttggacggataagtgatgaacttgcgatatccggaacggatcataataacggtatcgataccaatccttttcatgtgctgaaagtcgagatcccattctttttctccccagttctggtgtggaatatcgtgagatatttcatctagaaaagtgcctgtgattttcagaccattattcttcggtacaattaatttgctgtccgtccttttgctcggagagagaacgaattcacttccatctttgccttcagcggccagtagtgtgggagccattagggcggaggctcccgctaatgcggctttctttaagaaatctctgcgattattcgcttccatagtttactttttttagtttctactctttttagtatatatttaacctattgaatttttaatatgtctgatgatgtaatatatcattttatataaattaaaatttaatctatgaagagtaaacatttattcttgcgagtaaaaagggatagtttggcatttgcggcagctatacttctttttagttcttgtgtcgatggatacaaggatgattggaccttctcatcggaagttcagggggtaaccttggaatcaccgtcgactgaaggttggacttttaccagaaacgtagatattacgtctctggaaattaaatggccggtagtgctaggagccggtgggtaccaagtgacattttataatattgatgatcctgacaatccagttgttataggcgaagagaatgaagtcgtagataaatgtacgattacgcgtgatattactgaagatacaaaatataaggttgcagtcagagcattaggaaatcagaagtataataacgctgatgctgttgcagctacggaaatgacttataatacattggttcgagtacgtgaaacaataccaacaggaactaatctgaccgaatattttacggcaaatccgattgagcctcttgcagaaggagaagaagaaatagcttatgaattagtggcaggtggtgtatatgaaatggatggtaatattgatttaggaacgactacattgactattcgtggcgacaaagtaaatcatgccaaactgacaatgaaaagaaatgcttcttttataaatcgcggagctggtctaaaaattaagtttatagattttgattttgatgctgatacttacagtgcttctaatagtagaggtgtcgttatgttcaatagcacagaagccggtatagtgcagcagccttatgttttccaatcttgtactataaaagatcttcccgtaccattatattactgtaataatggttatgctttgtcgtcattgtctattactgattgcttggttagcattaatacagcaagtactatatttatagcattcaacggtcaaggttggatcaaagatttgagcttttcaaacagtactatttattatacggttcccggatctgcctattttgttcagatgagaggacgtactccgtcaaactttagcggatctggctggagtacatcgcttcggaaaatgagtaattgtacgttctatcaaattggcactaacaatcgtttctttaataatgtaataaacagtaatagtgctgtgttctttttggaaatgcagaatactatttttgcagactgtgtcgtaagttcggccacaggaactgaaggtgttttcagacggatctgtaatgcgggaaattatggtaatgtaaattatacacttggatataatacttattattatagtgctgttccgggaggattccttgattatgatactagtgatgagaatggacgagaccattcgggaacagctattaaggtagagccaaagtttgtgaatgctgctaacggtgattttactttgagtagctcggagcatattgcgaatcgttgtggagatccacgttggcttccgacaacagaatgaatacaatgtataaacaataacagaatactatgagtaaaagatatttcattttaggcttatgtatgctttttatacaagcctttgcgcaaatcgtctatgcccaaaatgcacgtacggtgaccggggttgttgtggacgaatttggtgacccaattattggggctgcaattaagattgtagattctacggtaggcacgataagtgatattgatggtaaatttagccttcccgtcccggaagggggaagattggctgtttcatttgtaggatacgtttctcaaacaataacgaatttgaataatccaaagattgtattgaaagaagatgtagctaatctggatgaggtggttattgtaggttatggtacacaaaaaatgaaaaacataacgggggcgattgaaaccattactccggatgagattaaagatctttcggtgggtaacttaggtgatgcattgagcggaatgatgagtggtttgcatgtaaattcgggtggtggtcgtccgggtagtaccccaagtctacaaatacgccaaagtaatatcaataccagcattactcccaattcaacgcgtggaggtgatgcagatcctagcccattatatgtaattgacgattttatttctacagaggatgcatttaataatttggatgtgagtgaagtagaaagtattacggttttgaaagatgcttcggcagctgtatatggggcacgtgcggcttacggtgtcatattggtgaaaaccaagcgcggtaaggtaggtacaccttccatatcttatacagggcaattcggttttactgatgctttgaaaaaacctaagatgctaagtgcttatgattatggacgtatttataatgccgcacgtgtagctggaacttctaccggtgaatcggaatcggataatagaagaacgcaatatttccaggctgacgaattggaagcaatgagaggactgaactacgatttgctggatgatgagtggagtgcggcttggacgcaacgccacagtttcagtattaatggcggtacagagaaggctacttattttgcgggtgcatcttactataatcaagaaggtaatatgggacgtttagattatgatcgttggaacttccgtgcgggtgttaatgctaatatcggtaagtggattaaagcctccttacagttctcaggtgacatgggtgaacagaataactcacgtaatggtataaccagtggtgggacagatgctgattttaattctctaatgacacatttgccttttgtgcccggatatgtaggtggacgtcctgttatatatacaggtatggaaaatgtgtcttcgggcttaagtgctgtacgactattccattttggagcagttcaggattctcctgacaatactcaaaatcagacaaataatatgtccataaacggttcattggaatatgattttggttggagcaaatggttgaaggggctaaaagtgaaaggttcttattcgaggagcattatcaataataagagtaataatatcggtactaaaatgaatgtctacaggctgctggaacgtggtggcagtggaaatcacctttatactggcgatgatataaatatagatgatagcaattttggtacttttactttggataatggtaatttattgagccgtgcgatgaataaaacggataactaccagatgaacttgacagtcagctacgcacgtcagtttggtttgcataatgtgaatggattgttttctattgaaaaggcagaatcggaatatgaatatctgaccggtactgtaactgatcctttcagctttaccgatggacaatctaattcgacagctaccggtgcggatcaaacgactacgttcggtcgtacggaatcgggtatgctctcttatatcggtcgtctgaactactcgtatgcagacaagtatttgtttgagttcctgcttcgttcggatgcatctaccaaatttgctcctagtaactactggggaatgttcccttcatggtcagcaggttgggttatctcggaagaaagctggtttaataaagaaaaactaggtattgatttcttgaaaattcgtggttcattcggtattttgggaagagataatatacaaccttggttgtggacacaactttatagccgaaatgcagatggaggtcctatatttggtacagccaccaatacctatagtggtgcaacattccaaatgccgcaaagaggggtcaacgcagatgtacattgggataaaacctacaagaccaatttaggtatcgatgtcaggatgctggatagtagactgggtattacattagatgcttactatgatatgggacgtgagttgttcacaactttcacgggtacttctttctatccgactactgtaggtacgcaggctactcctgagaactttggagaagttgatacgtatggtttagaacttactttgaattggaaagataaaatcggtaaagatttttcttattgggtaaaaatgactaccggttacagtgataacaagattaaagaagccggattccaggctactcccggttttgatgacattgttcggggtgaacgttccgaccgtggtgtgtggggatacgaatgtattggcatgttccgcacctatcaggatatcgaagagtatttcgcagtgaataagatcacttcttatcttgggaatacgaaagataacattcatccgggtatgttgatctatcgtgatgtacgtggtcagcgtaatgccgatggtacttatggtgaagcagatggcgtgattgatcagaatgactatgtgaagatttccaatcgtgccaataatccttatggattgacttttaattttggtgcttcgtataagaacttctcattcagtgctcaatttggtgcaagctggggtacttatgctcttgtacagacagacttacgtcaggaaaaatacgatgatctggaatataaaaatgtatctgccatgtggaaagatatgtatgtgtatgaagatgtattggatgccggtggtaatgtagtggcgccaatgaaccggagtgctaaatatccaaacttaagatatagtgccataaacggtcaggcttctacattttggaaagttagcgcagccagcgttcgattacgtaatttgacagttgcttatagccttccgaaggaatggacaaatcggatcggcatcagcagttgccgtctgaatttgactgctcagaaccttttaaacttttacaatccttatcctgatggtgtttggagtacatggggaggcacttatggaagatatcctaatttgcgtaaagtaactttaggtgttaatgtctcattctaatatcaaagaagattatgaaagaaaagataaataaaatatgtttgacagcatcgatggtgacaggactaatctgttttactggatgcagcgatgattttctgaaagacaagaaagtatatggaagctatgacgcttcggttgtgtacgaaaattatgaaacagccaaaagtcgtgtggactttttatatcagtctttattgcctagttctaccggaggttccaatgctttgaccgatataaccagtgcgggtattgatgacgatttttccaaatgtacggaggaatatggagactactctattttcaatgatcctacggcatctcttactattcagactgttcccgattatttttatgtaatcaacagtgaaagaagtccttggggacgtatccgcgaatgtaataatgtgattgaaggtgtgacgggaagtgcgactctttcgcagacagagaaagaacaattactcggacaagcttacttttttcgtgcatggcgttattatctgttggtgaaaatgtatggtggtgttcccattgtagaccacgtccagaatccggtgataggtgatggtaatggtgagaatctggtcattcctcgttcctcgactaaggcttgtatagactttatatgcgatgacttggaactggcagccagctatcttcctgcacgttggcagaatgaagggcaggattacggacgcataaccgccggtgcagcacttgctctaaaaggtcgtacattgttgctttatgctagtccactttttaaccgtgccgatgacgcatctcgttggaaagatgcttacgacgccaattttgctgccatcactaaactgaatgaaggtaacttcggacttgcttatgaaggcaatggcggagaagacaatgccaagaattgggccagaatgttcgccacttatacaggtggaagcgaagccgtatttgttactttatataataatgtgtctcctattgcttcacaaaacatcaaccgatacaacttgtgggagcagggaatccgaccaggaaatataaacggaggcggaggaaagactcctacagcggaaataatagacatcttcccgatgattgacggtaagaaaccgatggaatcaggagttcattatgaccctaaaaagttctttctaaatcgtgacccgcgtttctaccgtacatttgcatttccgggggtagagtggaaattcaacagtggcaatgtcgatttttcaggagcaacgatgtctggtttatgcccaacccgttataccagtggtgcgaactatgaactttggaattattgttggtatactacggctgatgagcgtaataatccgagtagaagcggttttgcagccgatatgctgggcactaagaatagaggagtctatgttcgtaaacgttcggatgattttgatttgggcactagtctttatgtgtttactgataacagcagtggtgatcagcagggattcagacgatcggcagctccttacatggagatacggtatgcggaagtattgctgaatctggcagaatcagcttgtggtgcgggcggcacttatcatgcggaaggggtcaaggcgctgaaagccgtacgtggcagagtaggctatacgagtgcaaataattatggcctggatgcggcgattgaaactgaccgtgctaaattgtttgaagctatattgtatgaacgtcaggtagagttggcttttgaaggtaaacgtgcgtatgatatgcgtcgttggatgctatttgacggaggtgtaggacaaggtgctttgaatgcaagttgggcattgagtggctttggaggtaatacttgtacttatttgggtgtgactccgatgaatgaacgtggtaagagatatcgcatagaaatcaatgttgaaggtaccgggtctgcaaataatgacagtgatccgattaaaaacgtagagcgaccagcagcactgacattgaatgagaagattgctacggaagcagacggagaaacgattcttgatccggctgtgtcaagtatatgtacattctatgatacctatttctcacgtaaagatatcagtcttgatggtaatgtgctggacattaatccttatttccaacccagatattatttctttggattgcgtcaaagtgcacagcaaactaatgcgacattgtatcagaccattggttgggaagattatgctcacggtggtatgggtactttcgacccattggcagaataaaagatttttctgattcccggaaaaaagtaatttaatataaaaaggtggcctcaaggcactttccttttaataggaaaagtgtcttgaggcctttttttgcatataattcccaattaacttcatttttgttctttttatgtgattacatatctttaaatcatacgtcctttttatgtatgaagaaaaagaagagtggtatatgtattttatgattatttaagtagtttactaacatgtcttcattcaagagcttatgggaagcttcttataattgttatcaagatggaaagcaattcacaagattaactgactgtcaaagtagggagctgaataaattgcattttcactttaatgcctcactcatcagagtgtgaatatagctaaagtgaaagtattagaaaaaggaaaggcatcattaatggtatcagttaaagtgctgtgccataatatatttctcattaaacgatttattttagtgttaggaatcaaaccgaacaaagaaataaatcgaaaactgtggaaagaagccattagttttgcagccattactgcataaatgtgaatgaaatgtttaacggactattgtatataatattcaacttaaatattgataacataagaacgtattgtttaatttaaatttaatgtatgaaaagtaatcgtttatttttacgaagaagaacacgtggactgttattcgctacgttattatttcttttaagtagctgtaccatagggtatcacgaagacgaatcttttgagtcggatgtgaaaaatgctacactggaatctccccaattggagaatgtaaaagtggaacttgatgccacaggagaaaatgcaactattgaatggcctgtagtgcatggagcagaaggttatgagttttcttggtatgtagttgatgatcctgaaaatccgatagctgtagttgaaggagagtttatcgatggttgtagcgttgaattggaagtagaagaagatacaaaatataaattcttaattaaaaccattggaaataaacagtttaataacaaagatgcagaaaaagcctgtgaaataagtttttcaactttacttgaaacatatgcatccattcctagtggagtagatttgactcaatggtttattgataatccgcttccagagactgatatggaacctaatgaagatggcactttaaaagagttggcatatgaattagaggctaacggtgaatatactatatcaggtccaatagattttggagcacgtaaagttacaattcgtggaaataaaattaatcattcgaaaattacatttggtcaaagtggtagaatattaacacagaatggtttgaagataaagtttatggatttctattgtaatgcaatggagaaaggttcttctgatgcttcattaattggattaagtaagactccaaatgaacaattaaaagtatcttctggagaatacgttattaaagatcccatcgttattcagttttgtaatgtatatgaccttaataggcatttattatatgattcagggaaaaaatattgtgtggaaaactttacagtaaaagcttcttttattagatgtaatcagtctaatacgattgtgtattttaataaaggtagttttattaatataacatttaaagagagtactctttgcagtactgtacagaatggaagttattttgcacaggtaaatggtaacagacctaacaacatgaagaaaaaactatatattctattgatatcagttttagggttaagcatacaatcctgttctgactatttagactctgactatatttttagagatcgggaaaccatcgaaaaagtttttacggacagagataaaacagaagcctggttagcaaatgcgttcagttatctaagcgatgcttgtgctgatgtttgtaacaaaagagtcactccacattgttttgcggatgatatgtattacggtgatgatgacggttccatacaagaatccaaagagggtgaattgtcatataatgaatttaaagaaggattgtatgatgagaatactaaacaaggtatgtgggaaagatgttatcagggaatccgacaagctactatttttattcagtatgtcgacatgaacgataaatttgaaagtgaagccgaacggcttgactataaagcacaagcccgctttgtcagagcttactactattggttattgcttcgtagatatggtccggtacctttattgccagataacggacttgattatgacgcatcctacgatgaactggctactccacgtgcaccttatgaggagattgctgattatatcagtcaggaaatggctttggcagctaaggatctggctctaacaagaggtcagaattctgctgcccgcccaactcgtggagcagctttatctgctcgtgcactagcgttgatttatgctgccagcccactagctaatggtaacaatgatgaattcgcccaactattggtagatgacaaaggcaatcgcttgctttctcctgaatatagcgaagaaaaatgggcaaaagctgctgctgccgctaaagatgtcatggatttaggggtatatgagttatatacggctgatagacgtacaacagattcgccagcggaaccggcaacaatcaatcccccatatcatgaagtatatagcaatgccaattatccagaaggttggaaagacattgacccgttcgaatcttaccgttctgtattcaatggtcaaatagatatattaagtaatcctgaattaatttttagccggggtagaaatattggagggcaaagtatcagggatatggtggttcaccagttaccacttaccgctaccggatggaatacaagtgggctgactcaaaagattgtggatgcttactatatgaacgacggaagcaattgtccgggtatgaactctgaatatgcgaatgtaccagaatataataacaatcatcgtttagacactcgtccgcgtgctacaggtttcacgactactgcagaagaacataaaccacttgctgccggagtttccttgcaatatgccgaccgagaaccacgcttctatgcttcagttgcatataacggagcttattggtatttaggtaatgaaaaagaaattgcagatagaaataaacaaatattctattatcgcggaaaaagggatggatataatgcaggtatgttttggttgcgcacgggtataggagtgatgaagtatgtgcatcccgatgacacctatcaaaataacagtatcgacaaccttcgatataagccggagccggcaattcgctatgcggacattttgttgatgtatgctgaagctatcaatgaagtgagtgaaggtacatatgatattccatcttgggatggaactaagactcattccattcatcgttcagttgccgaaatgagaaaaggaattaagcctgtacgtatgcgtgctggtgtacccgatttcgataacaatatatatgcagacaaggatgtttttcgtatttatctgaaacgcgaacgacaaatagagttgatgggggaaggaaagcgttactatgatatccgccgttggaaagatgcacgggtagaagaggcaatgcccgtttacggttgcaatacacttatgacagaatcggatcgcgaaatgttccatacaccgattgctgtttggaatttgtctgctacgttctctgataaaatgtggttttggccgatttcacatggcgaattgaaacgtaataagcgcctgactcagaatccaggctggacgtacaatgattaatcttaaacatggtaataaatatgaaaggaatatatactttactattttcactaattgtattagtgatgttcagtgcctgtaatgacgaatggaaagaggagcagtttgagcactatatttcattcaaagcaccgattaacagcaatggggtaactagaattaacctgtcttatagcgaaacgggaaaaacaacctatagattgcctatccttgtcagcggatcgactaaaaacgatcgcgatataaccgtaaaaattgggattgacgcggataccttgcgaacactaaacatagctcgcttttccagtcgcgaagacctttggtatagggaaatgccctctaaacattactctttccctgaaaccgtgcagattaaagctggagaaaatgtaggctatcttgatatagagtttgatctgactggactggatttagttgataagtgggtattaccgctgactattgaagacgccccaaatggtgaatacaaaccgaattatcgtaagcattatcgtaaagcattactccgcgtcatgccttttaatgattattcgggtacatacggtggtactaacttacaaggcaagttggtagatgcaggtgcaggagaaaatgagccattggtgaaaagtgaaatagtaacttatgctattgatgatgaaactatattcttctatgcaggtacaattgacgaaagccgacaggaccgtagaaactacaaaatcatagcccattttgttccgaatactaacattgtggagttgacaagtgataactccgaaaacaatggttttaaaataaatacccgagctagtagttatatcgaagaagagatggatgctgtccgcccttatttattgagacgtaccgttatgattcgtgatgttgactatgaatttgaagattatactttagcgccgggagccagaataaagtttcggtttgaaggtactatctccatgcagcgcaacattaatactcagatacctgataaagatcaggctattgaatgggactaatacgatgctaatttaaaaaaagaagggaaggaaactttaaccttgaagttaccttccctttttattctaatactatctttaacatgaccgagattctgcagacactcaaggaatatattcctatatctttggaggaaatgagtggcataaagctgatgaaccgtactgataccaaatatgtcacctcttaccaaatattaaaagagatacttcttgctgccggacatgactaccgcgttcaagaagtgaacggtgaatacaatattgcttatcatacaatttacttagatacagcagatcgtgacatgtatctaactcatcagaatggacgggtcgtacgggagaaaatccgtatacgcacatacgtagattcagatctcacatttttggaagtgaaaaataaaaataataagggaagaacagacaagaagagaatccgcatcgggagtattgacacgatcaaagaagacggtggtgaagcatttttacgtcaacatgcctggtatgagcaatcacaacttctgcctttgcttgaaaactcatttcgccgtattacacttgtcaataaacataaaaccgagcgccttacaattgatacaggagtaacattttgttgcttacaaagtggaaaaatatcaagtttggataacattgttatcattgagctgaaacgagatggacacaattcttcacctattaaagagatactacgtaaactacatatacaatcttccggattttccaaatattgtatagggtcagcacttacagtgtcacatttaaaatgcaatcggctgaaaccaaagttacgaatgctgaataaaatgggagtatattaatgatcaatataaaaacatacttatatatggatgaattagattttcttgatataatagaaactccactcatagacggtggtgactttttgcagttattgctgcgctttggcttcaactttttggtaacaggcattattatccaccttttctattatccaaagagcaagcggagagattatcacttcaccttcacattaataagtatcagcattttcttgatgatatttctgctgggtagtgtaaagttaaaggtcggatttgctctcggcttatttgctattttcggtatcatccgttatcggactgagtccatgcctgtacgagagatgacttatctgtttgctattatcgccatatcagtaataaacgcgttgggcgtggaagtaaactatggcggactaataggagctaatttattgtttgtattatgtatctggttgtgtgagagtaatcggtggctaaagcatgtttcatgtaaactgatactctatgatcgaatcgaacttatcaaatcctcgtgtgaacaagaattgattgcagatattaaagcgcgtaccggactgaaaattattcgggtggaagttgggtacattgactttcttcgcgatgccgccatgcttaaaatctattatgaaccgatgacaaatgagataaatacgattgatacattaaccaaaataccacgtggaaatgaataagaaactttttttggcaggtttgttttgtcttgtatcttttgctttacaagcacaaaaagacgatttgggtctatggaccagtgtggggatggaaaaaagattattccgggactttgatatttcgctggaaggagagttccgttcacgcgacaagttaagcgaagtgggacgttggtcgggatcggcaggtgtagcatataaaataacaaactggctgaaagccgcaacagcatacacttacatctattataatcacccttctgaaattacaaacaaagggaatgttatccctgaatattggcaacccaaacaccgtttctatttccaactaacgggaaaagtgagtttaaatagattcacattttcacttcgggagcgttggcaatatacctatcgacccagtcagtctgtatcaaagtttgatggtgacgatggtagtcctaaagacgatgaatacgtgaaaggtaaaggaaagaacgtgcttcgttctcgtctgcaagcaacatacaatatacctaaatgcagtctcactccttacgcttcgtgcgaattgactcatttgcttaacgataaaggggcgattgacaaaacacgctggaccttaggtgtagaatggaagttgagcaaacaccacggacttgatttttactatttgtatcagaatcatgcagatgaggatgaagcaaatggacatgtgattggcgcaggatatacatttaaattttagatctgtattatgaatctttataaaatactaccggctttattgattttaagtctgcttgcagcctgttcttcggataaggaaaacgatgtgtacactactttaccattttctctatccatttatcaagtagcaatgacgatagaaggcggtgaacaagaagtcaacgtatcttcaggcggcgcatggcaatcaagtatacattgcgattggatgacgctctcaccttcttccggagggataggtatcactaaggttcgaatcaaagtcaaaaaaaacacttccggtttaccaagaaatggacggattgcaatcatctcgggaaaagaagaaaaaggaattaccgttatgcaatcgtctatagaaggagaagaagattatcttcgtttgttgaatctgactatcgacggagtaactacagctgtggattatgtgaacaattcgtattatctacctatagatatggatgccgtacaacctgcaaaggtcaaagttgagtttggcggcattggagtcgactttatcaagatcggagataagaaaattaagtcgggcgagaatatagcactgagcctgaatcccggacaaaatatagaaatggaagcaggtaacaatactattgataaaattaggtcttgtcgattgattgtaactggtgttcccgtgattgagatctctgctcctgaaggtattgaggatgagaataaacgcccgtgtgacatagtgctgactgatcctaaacggcgcaccaacaactctgtcttacgatttgagagctatgccggtatcgagtttcgtggagcaggagctttacgttatgccaagaagtctttcagttttaaattgaaaaaccgtcaaacgaatgaaaatcaagacgcaaagctattaggtctgcgagaagatcaatcatggatactggatgctatgtggctggattgtagcaaaatgcgcaatcgtgtttgttttgatctttggaacgatttcaacactttatattatagtaatacagaacccgaggctgtgaatgctacacatggctatcctgtagaaatgatcttggacggagcttaccatggtttgtatattttaagcgatcgtatcgatcgtaagcagttgaaaatgaaaaagaaaggtggttatctctataagggtaaagaatggacggatgaatgtaaattacaaggaatcaatactccatatagtaactccaaacaggcatggcagggatttgagtccgattatccggacgaggtgggtgaaatcgaatttaaatatctttccgatcttatccagttcttcgctgcagcatcaaaagaagaatttgccgcccaatatgaagagcgactggatgtttcctctctgattgattattttatctttattaatctgctgtcagcttatgataacacaggacgaaatgttttttggggtatatacaatgtaaatctcactttattacccaagttcattattcagccctgggacttggatggtacactgggacgcacttgggatgccattaagcttgatcccgaaaaaggtcttggttttgacaacgggctaatactccgtaatgatgccggttccaaatacttccgcccctttgagagaattatgaacgagaacccgaacaatatcaaacgccggatatacgaacgcttgatggcggttaaagataatgttctcagcccggcaaacctggcttctaaagtagattactataaaagacagattgtggaatcaggcgcattggaacgagatcgccaacggtggacaggatattctatgtatggatatgctaatcccgaagaggaagcagaatacataaagtcttggtatattgcaagactgaaatatttggaaacaattttcaacaacttctaaagctttatattatgaaacaattcgcacagacctattatttacttcaattcataatttgcttaatttgcctgtctatctcctgcggagaaggaggaaacgataattactcggagacaaatgatgaaaggaacaaggaacctgaaataacagtttctccaataactaacttggaggcaaaatctacacagattgctaatcaactactgatcacatggcaaaatccgaatactcctaatttactcggtgtagaactttcttatttgcaaaagaatggcggtacacataacgggaaacaaattattcaaggagcagctgggaaaactggaaactatacattacaattgccacagtacggaacatatgagatttctgccatagcaatagataactatggtcatcgttcgtcagcagtaacagtaattgctacacctgctgaaaccactgtccctttttcttgggcaactcttgccgacagttgtacatatgtcttaatagagcaattcatgaataaaagtaaaggtacattttggagtacacccaaagatatgtcggacgaatcgacttatatctactggcaacaagcgcatgctatggatgtagtgatttactcttataaacgtattaaagacacaaataagcaattggctgctacttaccgcacttattttgaacgctggtatgccaaccacgctaacaattaccaccgtaatccatcagatgaaaccggcttcctaaatgactttactgatgacatgtgctggatttgccttactctgatacatctctccgaagcaacaggtgacgaaaaatttgcgcaaaccgctaaaattgtatacgacaaatacattattactcgagcatggacagatgataaaggtacgggacttccatggaataccacccaaaacgaccgtaatgcttgcactaattctccgggttgtctggtagctgctaaactctatcaacgatatgaagatggaaattatttatctgatgcaaagaagttgtacgagtatgtggtcaataattcgtataatgccgatggacgagtggaggaaccacctctgacttatacacagggaacatttggagaagcctgtcgccaactataccatatcacacaagaaagtaaatacatggacaaagcaaaacaagtgatcaactatgccgctacaagcgatcgttgcttacgaaatggtattttacgtgacgaaggcagcagtatggaccaaagtatttttaagtctgtttatattccatatgcagtgaaccttgcattagacgaggcatctagttctataggcaaacatttgataacctttctgaaaaataatgctgaaactttgcgcatgaatttgaatcatgcggcttacccagcgatgtattgcaattattggtggggtgaaatgtggaaatccagtgaaccagcttcaatgggagcacaagtaagcggggcttcgctaatggaggggatagctaggttagaataatcttggttggtattttcaggaatatctctttaactttatagaaatagattttctcttaatgtggaaaaatctatttctataaagcatgaatgttatatgaataagaaatatttctataaatatgcaattagtaaacagcagcaaattcaaaaagaatctaaccatttatttcaagtagcacttttatttttcttctgcagtctgattcagcctatagtcatttaagactagtgtcaaagttagttcactgcaactctacttttcaaatatacacttatattttgttgtgatatttaatactgcaaatgtaaatgtgtcaaaactctggcacaacctctctttagaatggaggaaatacaatagccttcgctctttgagttatatgactacatcgctgttaatatgtgttttgttggaaaactcttttagtgagttctataggtctgtaagatgcgagcactggaaaaaattataatcaaagattgttgttttttcgagaggatgtatgatattttttagtatatgatgtttgtgttttcttattctatagttcttgttctttctagcagtgaaaaaagtaaatactggcttttactgtagaataatgcataaaaaactattttgataggatccgtagctgatggctcgctattttgggatgtcatatatcctaatctgatgaaaaataaacttttgctctccttgcgtattcaacgcaacaagttgatacatactagcgagcagacacaaatcggaaaccactatatcctcgtcagtggcttgttgcaggaatctttaatttcttcaatttttattttgtaatattggctgctttaacttaatccataaacacaacataggtgtatctttgaatttagttaaacacacatcagcatcatttaacgttagaaatctattccaattgtcagcttttaatagagggatttctactgcttcatcgaataaagtaaaggtagctcccatatcattaaacactctaacaatcctattagttataatctctaattctttcgccagaataggttgcttcaagtcgttgttcttatggagtataataaccgtctcatcttttgattttctttctatcatgcagttaaaatatccgaagtatttataagaagtactcagataagttaaaaattgcccagattttgtttcgactctagttacttgccttgtaatataatcgctaagaacttcatcaaaatattcacgcgcagattttttattgttatttattgcttcatcaaatttttctataaactcatctattgaatatactttagtgttgaaattgaaaagtttgtataatgttttgctcttgaggcgcataccttcgtcatcactaaccatgcaatcgcagtatgagccgaagaaactgtggtaacagtcgacttgcatatttctaaacttaaccttcttccgggtttctttattaactccaaatagatcaagaagtatatatgacatataatataccgttgcaaaatcagtgtatgataatcctgtttgagttaaagaggcttgaataatatctagaaaggataatcctaatggagatgaggctaactgctcgttaaaaacattttcaccttccgctttaattgatgtcggattatatctagcaatagtattgtctctcataattttgtatgactccttattctcataaaaatagtgggagacgaatttcattaatgatgtaaaagttgatatgtccatttggagttcatcgactgaaattggggctcttttttttagccaatcaaaatctaattcaccttttaaatccttaatgctaatatcaacaatgttattgataacattccgctgttcttctgttatttgtgaaaaatcaaaattttcaagccaagagaaatcctctattttgcctatagtttcgaaagcattgcgtggggattgctttataacttcctgtttatggttttcgtatattaaatgatatccacttactatcgattgcatatattccatttcagtatatttaatatccgttttatcatcttgcaaatcaaataaatgagcatttgagtagaagaaaataaactcatctttgtgagataatatcttttcacgcaaaagagaatacttttcttcttttgcattaaatagatgactgaaaacttgtttatccaaatatattgtaaccataaattgtaaaataataacgatttgtttgttgtttttaccttcttcaatactaaaccttttcgttgtatttctggaagatttttttaatcttctttgtcttaggaagtttgaaagaagggttaaatagagtaacagattggcaatcgtttctgggctttgttgtgcattgctgtcaatatcactctctttagtacaaaattacgaataaaaatcagaagcacatcaccccgtcctgtgttttttacgtggaggtctttttgccatcaccaaataaatccggtttaagcgtaatatcaattcttagtgaattaccgactattattgctggaatttatacttcaatccatacttcttccagtttgctatacagtgttgtacgttcgattccgagcagttcggtggtaacctttcattttctgtttgcctgtttcaaggtacggaaaatcctctctttgttttcagcgtcattgcgcagggcgaagctgacggatgaggttgctctcgtcatggtaagctacaggtgctctttcgtgacaagatctgtctgtacctgtaacaccgcatccataattttctatcgaaacttaaggacattgcccggtcacgcatgggcagtaatgtcttattgcgcacgtcatggatttgcgacccttactcccagtaggtgtattctcgttgagagtataagccgagtattgcggcatacgaaattatcactgcatagaagtatgttatgataaccatctgaaaaatagacctggatttgacaacgtttggcaacagacttaaccagtcatctactgaaatctcagtggctatattactcatggaacgaacaattataacaatcagagaaaacggcagagtgaatatcccgaagggtaatgtatggatgtcagaaatggagttggtggtgctgttcggagtgatagctcaggtattccaaattgtcatcagagtgatatacaaaagtgaaacactcacccctatgacaactcaacaatgtactgttattacttttacaagttggaagatattctacaatcatgaaattattattgtccttgtgttttagaagaatacactatttcatccacaagttatattaaaatggtcatttactacattttcagtttgggaagaagtgatgggaacagattgacttactacacaaacataagataacacatccgtctgcctcaccgcttaccgttgaaaccttaagagaattttatgtgattcgattattgtatttaaagataggcgttataaaattggcttatggtacatattagggtaagtataatacttatttttagctttaacctcattcttacatcaatttatacctcacctaggcaaccttatttaactgtaaccaccactatctatgtatctgtcattcattggtaaatagaaaaaatgtttttttcaaatataatcaaaactaaaaaatggcttattctattcattgaaaactgaaagtgtttttttagccatttcgattcgctgattaaagaatatacgagttttttcccaagagtaatatgggaaacaagcggttgatataggaagcgctgctgcttcctcatttaacagaatcttaacccaaattctttggtctctgtcacgatagaaaagccactgtacattagcggccattggagatatttcataatccttccaatagactgaaacggaatcgggccggcaaacctgtacatcagttttttctatgcccatcaacgacacaaaaggtataactgtttctgcatgagcaaaacgaaagttagcctgataatcggatttcccacttatcacctcttgagcagaacgaatgaattcagaaagcaaaggccaagcgattgcaaccggtaacatcttaccgacaggtgcagagctcttactcatatattgtcgcaaattctgggtttgccaataacgatgccattcatcaagtgtaaaaaggtcttccaaatttaatgggatgcttgtatcaggaagaatagccgcaacagaaaataaagccatgacaaattcctctgcctctttatccagatattgttccggattaagaagaaacttcttcattataggaactggagatatcttcttgtgtacaaaagctttgtatataggaagccagtcacctttctctttataattgacataagatttattcagatcaaaaaaacgaaggatatgattatattgttttccttcacttcgctgtacctgtaaagctggattatgccttatcatgcaagaaagaaaagcgtccatactatttatgctgcggggaacataggttgctattgcttcaatcttggcagaattgctgaatagttgaggatagttccttatcatacgtccggcaattccttcttgttccgtctcgcccaactttgacaattttccccattgaccgtcaaataatctggataaacgtcgtatcatagagagtaaagccatgccttctgaggtcagtccattctcttgttgggctgataccaataccttctccactttgtctagggcttttcttgaagttgggaagcgggctccatgtcttcccagatgatttatataaaatggggtcataccatcccgaaaagtaatggacgagtctgtcctattaggatagggcatggccgtccctgcatacttctgtatcttagtttgtccccatataacaggaaaagtgagagacataaaagtcaaaacaaataataatcttttcatattatacctacttaattcataggctataacgataaaaatgaggattatgtttgctcaaaatcaatcttaagacatccaaaatcttcatgtccgcaaatagttgaacaaacgaataaaatacgaaccaataatgattatcactatatgaagttactaaaatgattgaaaattagaatattcttttattaaataagtggttatccagatgatatattcagcagattcatttgtttgtcactattttaaactttatatttgcataaagaattaatatctatattaaagaactgattttaacacggaataaatggacagcctttacttataaaaacaaaatgggcgaagtattgaattatatagaattatataatttttattgagaaaacattatggagaatacacaagaatccactcaagtgccttcggcgcaaattgagcaggtatcacaatttcaagaatccttaactccgaccttgctgaaggagaatgactccgcttatgagtctgtccgtgatttacgggaagcactcaaggctgaggatgttttgaatattgccctgaccggtccttatgggtcaggaaaaagttctgtattacacactctgatgtatttgaaagatgaaaaatggaactatctgcccatatccttagcaacattggatgacgacaaacatcaaaaaacaaaggatgaagaaacggaagaccaacaagaacttctggataaccaaaccagtgaaaaatctacaggtaaagataacttcgatgaccgggatagtgaaaactataaagaaaaactgaaccgaagaatagaatacagcattctccagcaattaatttaccgagaaacgattgatactctacccaattcacgcttcaaacggatcacacacattaccccaaaacatatatcgaaattagcatgtggttttatcggaacgattcttgcatttgcaatccttttcgaacctagttggatgagaattgactcgttttatcgtgttttcagtcaaggatttgtttttaacctaataggggatattgtggctctgctatatctgttatttgtcttatatacaatagcacaatatgttatccggatatatggcagtaccaaactgaataagctcaactttaaagacggcgagattgagattaaagacgaaaactccattttcaaccgccatctagacgagattctgtatttcttccaggcaactgattatgacgtagtggtcattgaggacctagatcgctttgatacccccgatatctttctgaaattgagggaactcaacttcttactaaacaattcggctgtcgtaggacgaaagataaaattcatctatgcagtgaaagatgatatgttcaaggattcctcccggacaaagttctttgattatataaccactgtcattccggttatcaacccttccaactcgaaagacaaactgaaagaagaattggaaaagagagggcataaggaggagatcaaagctgatgatttggaagatatagcctttttcatagatgatatgcgcttgttgaagaatattgcaaacgagtatcaccaataccacaagcggctttttgtcaacggtacggaattaagccactcaaaactactggccatgattgtgtataagaactattatcctgatgatttctcagcactacacaacagacgtggaaaggtttatcaatgcgtatgtcatgaaaccaaacaggaactcaccaagtttgcgctccagatattgaacaaacggaaggaggagatggccaaacgtcgcgaaacaaaggaaaggaaccgacacctgaaggcaggtgaattgcgaatgatttatgtaaacggatatgttacccatatcaacggcaatctaatttctataaagattaatgataactattatgaaacgagtgctatatggaaggatgaggatttatttaatgagctcatccaaaaagagagaatagaatacaaatattttaattcatatagtatttatacatcccatacaaacatccgctttagcgaaatagagaaaaagattgatccaaaaacatcttatgcccaacggttagccgctattacaacaaaagacaaagatttagccagggaagaggaggaactgaaaaaggaagaatatcgtatcaacagtttttctttgaagcaactgtttatgcagtttaagatgaatgaatgtgaagctttccagaaaatcaaattggctccaatgatggatctctttatccggcgtggttatattgatgaagactattatgactacatttcttatttctatccgaacacgatttctcagaatgaccgtcttctgcttatagccatgaagctggacaaaagtcccgaatataatgccaagatagacaagatacaaagttttgttgcacaattaccaacctatgcttatctcagtgatagcgtgcttaatattaatctgttggattatttgggcaaacatacgaacatcgaacgagaacggttccttctattcatggcacgattggaacaacccgtagctaaaatggattttctggcccaatattacaaagagggaaaacaaaattataatgtgtttaatcactatatcaattggaacgtcaatgatagctggacttcggtattgaactgtgagtacagagacattctgatcgaagcatggttaaagttttgtgagaacagccatataggtgagtttcaaaaaacatggttgaaagataattatgattacttagcaaacagatacgattgctttgacgataagaaaatcaactttattgccagtgtatgctgttatgaggaattgacaaatacttccaaacccttgttggaacttattattaaaggtgacagctatactttgacgagacacaacataagcttattactgaatcatatcagcgatagagcaggtgcaaatgaaaacaatatcaccctaacgcgcatcaaaagagtcggacggaaagacgtcattgaaaggatacaagaaaatatggaagaatgcattcaaaatgtcttccagaatatatgcgatgaagatgaagaatccatgctggagattttaaataacaaggaggttaaaatggaggttaaacagaaatatctcaagacccatattaatcctatcaatgatgtatctaaggtgaaagatgacatgaaaggtttagcatttggactggatttactagtacctaactgggataatataaccaattactatgtacaaaacgactgtaatatagacgatgtcttatgggcatatttagataaacatgcggaaatactgggaacaagaagatttgcaggaagtgagccacataagcattcgctatttaataatattatgggtagtaaccggattagtattaattcctacaagcagatattctcagccttcctgtgtaaaatggatctgaatgaggaacttttaaatttggaagatgagcgaatcagctatttaatagatcagaatagcattgagtatacggaggataatatccgatacctcagccgtcatagtgatatactctatggcaattttctgttgcatcataaaaatgagtttttaaaggacaaagataaaatagcttataacaaagacctggctctctgtttgcttggtagctacaagttatccggcaaagaaaaatcagttgtgctccaacaactgaaagcaacttccatagatgtcagtcagaaactcgccaatattatctgtgaaatattaacagattatgaaacagaaatagattatgacctgctgaaaaaggttcttgtcaaggcatccgtattagagaaagcaataacagtcatttatcatactatcagacaaaaccaggataaccatgatgtgattgatgagctattggcattgttgccattaccctacagcaagatgaaggagaacggaaaacacccaattatacccgacacagaactgaaccgaagccttttatcattattaaaggagtgtaactatatatcgtctttctccaaagataaaaacggattgaaggtcaatacgagaattatcaaacagtaggaacaattttatgccttatagaaaaagacacgtcttcgaaagaaactgaattatctaataatttgtaagctgaagaaactttagttccaaactgcagaaactaaagtttaatcatacaaaacaatgtattttgttgtaactctctgaagataaaacaaatatagagagtttaaaagatgcaggtaacgatttggtgatggaagtcttgcttcgggttacactgctttgcatagtttcaaataactcatatacaaatgtaggcaatatttagaatatagcaaaatataccatattatagtttaatcataatttaatctcattttcatcgtattgagaacgttctggcttgcaaagtaaacgataatctttcaaattgcaatattcagtttgcagatattgttaggaatttataaaagagattcaattagggaaaaatttctctaatcccttcttccttttcaaagaaagtattacttttgtacccggatttacaaggaggcacccaaagctcctcatgttcaggtgaaaagagataataaaacgaaataccaattttaattaattcaaaaaaaatggcaaatttagatttaagcaagtacggtatcacaggtgtgaccgagattgtgcacaatccgtcttatgacgttttgttcgctgaagaaacaaaaccaggtttggaaggttttgaaaaaggccaggtaactaacatgggcgctgtaaacgtaatgactggcgtttatacaggacgttctcctaaagataaattcttcgtaaaagacgaaaccagcgaaaatacagtatggtggacttctgaagaatacaaaaacgacaacaaaccagttgacgctaaatgttgggcagctgtgaaagatttggcaactaaagaactttctaacaaaagactgttcgttgttgacgctttctgcggagctaacgaaaactctcgcttgaaactgcgcttcatcatggaagtggcatggcaagctcacttcgtaacaaacatgttcatccgtccgacagctgaagaactggctaacttcggtgaacctgatttcgttatcatgaacgcttctaaagctaaagttgaaaactacaaagaactgggcttgaactcggaaactgcagttgtattcaacttgactgaaaagatccaggttatcctgaatacttggtacggtggtgaaatgaagaaaggtatgttctcttacatgaactacttattgcctttgaacggtatggcttctatgcactgctctgctaacactgataaagaaggcaagagctcagctatcttcttcggtctgtcaggtacaggtaagactactttgtctactgacccgaaacgtttgttgatcggtgatgacgaacacggatgggatgacgaaggtgtattcaacttcgaaggtggttgctacgctaaagttatcaacttggataaagaaagcgaaccggacatctggaatgctatcaaacgcgatgctttgttggaaaactgtacagttaacgctgaaggcgaaatcaacttcgctgacaagtcagtaactgaaaacactcgtgtttcttatcctatctatcacatcgaaaacatcgttaaaccggtgtctaaaggtcctcatgctaaacaagttatcttcttgtcagctgacgcattcggtgtattgcctccggtatctatcctgaacgcagaacaaactaaatattacttcttgtctggttttacagctaaattggctggtacagaacgtggtatcactgaaccgactccgacattctcggcttgtttcggtgctgctttcttgtcactgcacccaactaaatacggtgaagaactggtgaagaagatggaaaaaactggtgctaaggcatacttggttaacactggttggaatggtactggcaaacgtatctctatcaaagatactcgtggtatcatcgacgctatccttgacggttctatcgacaaagctcctactaaggttatgccttacttcgactttgttgttcctacagaacttccgggtgttgatccgaagatccttgacccacgcgacacttacgaatgtgcttgccaatgggaagaaaaagcaaaagatttggctggacgtttcatcaagaacttcgctaaatttacaggtaacgaagctggtaaggctttagttgctgctggtccgaaactctaagccttttaggcaatagatatgtaatgcaaaatgtgggcggttccgaaaggagccgcctttttttgtttatatgaaggtgattttgtatctttgttaatctgaattatgttcgataaaacgctgacaaatacatgattattacttatttgaaactcttttgtacattcgcaaaaatcggcatgtttaccattggcggaggatatgccatgattcccttgatagagcgggaaatagtcaagagaaaatggatgagcaaggaagaatttatggaaatgtttgccttgactcaatcgttgcccggagtttttgcggtaaatatatccattttcgtgggatataaacttcataaggtcagcggaagtctggtttgtgcgttggcgactattctcccttcattcgtcattatgatgttgattgccatgttctttgcccgttttcaggacaatgaggtgatgattcgtatctttaacgggatacgtccggctgtagtggcgctgattttgtttccttgtatatctgcggtcagagctttgcatttgaagtatgtgcaactgatagctcctgtgattgccacagtactgatctggcaattcgggctttctcctatttatgtggtattggcggggatttccggtggattagtgtatactctgtggttgaaaaataagattaaagatataaaggcatgatatatttacagttactttgggtgtatctgaagataggtacgtttggtttcggaggtggttatgcgatgctttcgttgattcagcatgaaattgtagatctccaccattggctgactccccaacaatttacggatgtggtggcaatttcgcagatgactccggggccgattggaattaatagtgctacttatgtgggctatgcagtgacacacagtgtatggggagcggtacttgctaccgtagcggtgtgtctgccctcttttattctcgtattgctcatttcctatttctttgcgaaatgcaaggataataaatacataaaagcagcgatgtccggcttgcttcccatgtcagtggcattgattgcctcggctgccttgttgatgatgaacagggagaattttattgattataaaagtataggaatctttgctggggcattccttatcacctggaaatgggatttgcatcctattctgctgatttgtctggcaggtctggtgggggtgatcttgtattaaaaaaactttttataaagctagggttggctactggatcgtaaagaagttgcttaatatgcatgaactggaaatagaaaaagcccgctaaataaaatccggcgggctttctgcattatctcgggctattgcttatgatttgttcgcgcgtttacgctcgatttcgtccagaatgactttgcgcatacgcattgctttcggagttacctctacgtattcatcttctttgatgtattccaatgcctcttcgagtgagaactgaacaggcggaatcaaacgaactttgtcatcagatccggaagcacgcatgttggtaagctttttggattttgtaacgttgataaccagatcgttgtcatgggagtgttctcctactacctggcctgcatatacttcgtcctgcgggaagatgaagaacttaccgcgatcctgcaatttatcgatggcataggcaaaagcagttccgctttccattgcgatcatggaaccattggtacggtgttcgatttctcccttgtgcggctgatattctttaaaacggtgtgccatgatagcttcaccggcagaagcagtcagtacgttggtacgaagaccgatgataccacgtgaaggcatgtcaaattcaaggttgatacgttcgcccgtattttccatcttcaccatttcacctttgcggcgggtaaccatatcgataatcttgcttgaatattcttccggtacgttgattgtcagttcttcgatcggttcgcacttgacgccgtcgatttctttaaagataacctgtggctgacctacctgcagttcgtatccttcacgacgcatggtctcgatcaatacagaaaggtgaagtacgccacggccggaaacaatccatttgccgtcttcctcactctttcttacacggagtgccagattcttatcaagttctttcatcagacggtcgtggatgtggcgtgaagtcacgaacttaccgtcttttccgaagaatggagagtcattgatggcaaatagcatgctcatcgtcggctcgtcgatagcgattggcggtaatgcttccggattttcgaaatcgcagaccgtatctccgatctcaaaaccctcgatacctaccaatgcacagatatctcctgatgaaacttcgtttgtttttacacgtcccaaaccttcaaatacatgaagctctttaattttagatttgaacatatcgccattacgttttaccagcgtgatgttcattccttctttcaaggtaccgcgatgtacgcgacctacggcaatacgaccggtataagaagaataatccagagaagtaatcagcatctgcggagtaccttccagttgttcgggagcaggaatattttcaataatacaatccagtagcggggtaatggtatctgtcggcttttgccagtctgtgctcatccagttatttttggcggaaccgtaaataacggggaagtccagttggtcttctgttgcgttgaggctgaacatcaggtcgaaaaccatttcgtaaacttcttcagggcggcagttaggcttatctaccttatttactaccacgattggtttcaaaccgatttccagtgccttctgaagtacgaaacgtgtttggggcatcggaccttcgaaagcgtcgactaacagaatgcagccatctgccatattcaatacgcgttctacttcaccaccgaagtcgctgtgtcccggagtatcaatgatgttaattttagtaccgttgtaattgatggatacatttttagaaaggatcgttataccacgttcacgttccaggtcgttgttatccaggataagttcaccactattttgattgctgcggaatagatttccggccagcaacatcttgtcaaccagcgttgttttcccatggtcaacatgggcaatgattgcaatgtttcgaatattttgcatataatacctattatttggctgcaaaggtacgaaaataggattagaaataaatgcaatagccccattttttcttgtaaaacgttgtgagatataaagataatgtctatctttgcacgctcaaaagaataatttactatatcaaaattctaaaaattatgtatttagacgcagctgaaaagcaagaaatctttggaaagtacgggaagtctaactctgatactggctcaactgaagcgcagatagctttgttttcctaccgtatttctcacctgactgagcacatgaagctcaacagaaaagattatagtacagagagagctttaacaatgttggtagctaaacgtcgccgtttgctgaattacctgaaggacaaagatatcacaagatatcgttctattgttaaagaacttggtttgcgtaagtaatctacttgccgcgaaaagattaaaaaccgtttctcacattgagaacggtttttttattggctttcaatgaaggattagtattttatgctgtgcatattgattgcagccggctgtccgttgtatagtgcttcacaactaattgtcaggaatgtagacgagttcgcattattacagcgaatgatggctactccattttcgtcggtggtaactttagggttccaatagattgtacggcggtggtcattgccttgtcctttactgatatccgggtaatagggtgaataaaattcaatgggctgggagtaaccttggatctgtgtgtttcggataccacgtgattggtacttcttttccgggtcccaattgtcgatggtagtgatatagcaaattgcaaattgatttcccggttgattattgggagttgtgttgttcagataacttttgagagctttttcttcaaagggagagagtctggaagtttccatgtgattttttagactttcgtcgctcaggtgataagcgctgtcgtcatcaattccggcacttgctgtcgtgccgtcgcaaatcataacagattttatcgcatcgatatttttatctataaaaagctcccgatcaaatgttgagtaaagaactccatttatgacgcatagtatataatgattcttgtatttcatggttataaatggtggatctcccttccacttagacttcacttgaatattgggatttaatgtggtcattagccaagggaaatagtccatgaattttccttcatcgcgcattcgatccagttccttagggatatcataataagctcttacagattgctcgaaagctagaatttttttgtatttcgtacgtttggctttaatcgttacctgatccaacaaatgagtatcgtgtcccataattgaatctagataaagagagtcggagagactgctccaccaactgagtccgctaatatcttcccatttaggatgtagctcttcgtaagcgtatttgcgtagttcgggtgtaaagttgcggaaaagtgatatgtttgttttccggttcagcttttttcctttacggcgagtttgaatagccgcactcatggaaccattgaaggcatccattggaatttggaagaatcccaaagagtctgtgaccgtagtacctgctgctgatatcgtatctctccgggcaatgacgcttacagagatctctttttgttctttgtttctcagaaaagatgttacctgtccatgtagagtcagtctcgtttccggcagatagattggtgtttctggagtggcactgatggcttggcttatatcatattttctccatccgtgaatcatcaacagaatatctaatgccactcttcgtctgggagaattgtttgcgaaataatatccaggttgatgaatgtatcctttcagatctgatgtaagtaaaaggtctgtgtaaattgtctgatcgaaccgttggaagtctgattttaaagcatcccgaaccgctacggagaaatgtccttgtattggttgacctgtatggtttttcattgagatatgatactcaattggttcaaaaggatagtataatgcattggtggatgtggctgttaactgtaaagatggagaaggcatcacatagcaaaaacgctcgcataacgttgccccattgctattcattaaagagagttgtatgactcctcccggcaatccctgagtggataacgggagatgatatactgtttgatctttaaaatcaagggtctgatacatgagcggacgtccttgatgtgatatgaataaagccagtgtatctttgagacttgtcgaatttctgagaactttgatgactaatgctttttctttagacgtcacatttagcacatatccttggggtaaagccttcggtagctgaaatgagtattttttatcttgataggtcactacagctttggcttgtttgtctgtaggggtgtatgtaaagcatcccataccgtcgtggagagttgtaaattgtgcaagttctacatcatccggcccataaacagttcctgaaatgcctactgtaccttcttctttacttgtcgcttcgaatgcaacgactgaaggtactccctctactaattgtccaccttccgggaagaatcgaatcatgaaatctttttcttttgaacgcggacgttgcttcatagattcatccattcggtaagtgatgatgctccggttttcgtctacttcgcttctccgttttctatatacagggatcgtacgcgagaaatattgcttttcactgaatgccaacatccatttcgtataagccctgatctcgtaaaaaccggagaataaggcttttgtcagtatgaattgtccttctccttctccatcccgcaactgtatgatttgccgttcactagtatttcccagttggtctaatagctcaacataaaggggggtactaattgggctaggttggttttgctcggccgttactacgtatgccttataccatatcgtgtctccgatgtagtaactggtgttgtccaagtgcagataggctttctcgcgtggatatgcatcggcgtaggcttgagaacgggcaaagtaagttgcgaatatagaatccgcaacttgctggctatggatttgcacggctatacttgataggaggcagaaagtgatgattatggagcgtattctcattacattttgaatgatcagtaacttgaaggttggggaacgtcaagtgttagcataactatacttgtttgattactaactgttgcgaaatgaacagttgagccatcgtaatgactggagttggaataatttgtgcgataagcaaatgatacttcatctccttttgtatcataagaaaagtatccccattgaataggggagtctttattccaaggatcatagactgcagagaccgtaatgggttcccaataaccactgcctgtaatgagtacatcgcatgccatagggaaaggtatatcgggtggaaaacgaaaacaaatagaaccatacattgaattaactttagagaaagtgtactcttgcttatcaaaatcatatccgacgaagtttgcatagggattccatgggcctttatcaggatatggtcgatcatacactaactctgagcaggtagcacgaaccgcaatatatcctcctccttcgggaagttgtagatcggttacaggtatttggattgtttcataggttccttcttgaaccaaaacttcacggacaggaaagaaggaatattcaactggattaggatcaaaatcacgacttgctcctaattgaatctgatcatatttcccttgaccttgtcgtatctgaatatttagcaaaggtggaaatggaatatattgactccattctattttaataatctgaggtaattttgcatgctcaaaatactcgtcctggctcgttcttgttgttaccactttactggtcgcttctatactaacagggctgtcttccttcgtacaactgcaaaaaatgattgagaggaataatactaatagtaaatggattctttccttactacttgtgaattgattgtgtgtgttcataagctatatattttagaggcttaacaataactacttatgatctatgattaagagaaatctcagaacgtttgggtatttcagtaaatactgtagaatgtcagatggggatagcactcaaaaagttaagggtaaaactaaatatttgccttgcagcatgagttttaataattttattgatatttttttaggggtatttactgggataatcgttcttttgtaaaaaggaacgaataatgggaactaatttaaataaatattttgcaggtgaattgacttcagaagaaaaggaagtcttccttctgaatgtgaagaataatggggaaatgcgcgaagaatttattgagtatcagagtgttgttgctcttgtggattggtcgttccctaaagatgataaagaacttgctaagcaaaaactatctgaatttatgagtcggatagagaatagcgaaaataaaaaggcttaaaaataccatgaatagacttaataacatcatattactagtcgtctttatatgtacgcatgctcattcgcaacaagcttattttgttgatggatatcatggagggatatacgggcattatccggtgaagtggaaaactcagtttattgtcgaccagttatccaagcatccggattggcgaatttgtctggaaatagagcctgaaacatgggatacggtgcaaatacagactcccggagcctatcgacaattaaaaaacgtagtagtaactaagcaggtagagtttacaaatcctacttatgctcagccttattgttataatatatcgggcgaaagcattatacgtcagtttcaatatggtattgctaagataaataaacattttccgggagtgacttttaccacttattctgtggaagaaccctgtttcacaagttgtttgcctcagatattgaagttatttggttttaagtatgccgtactcaaatgcccgaatacttgttggggaggatacactaacgcttatggcggcgaattggtcaattgggtaggcccggatggaactcccattcttactgttcctcgctatgcttgcgagaaattggaagagaattctacttggcagacaactgcttggtgtaatgaagaatcttatctgaatgcttgtcgtgatgcagggattgaacatcctgtgggaatgtgtttccaagatgccggatggaaaaatggtccatggttaggaagtggaaagaatacaaaaagtaattcagtttatgtgacgtggaaagattattttgaaaatatttccattggtaaaacgaatgatgactggcatttctcgcaggaagatatacgtgtaaacttaatgtggggaagccaagtgttgcagagaattgctcaagaagtacgtacttctgagaataaaataataatagcagagaagatgtctgttattgctcatcttgccaatgggtacacttgtgttcaggaagatttggatgaagcatggcgtactttgatgcttgcgcaacatcatgattcttggatcgtaccttacaatggcctaaataaatttggaacctgggcggatcaaataaagcgatggacagatgagacaaatactgtggctgataaaattacagctgcttctatattcagttttgataacgatactattaatactgaaaaagcccagggatttgtacgtgtttataatacattgggaacaaaaagaaaagaactggtaactgttgaactccctcaggaatatgcagactttgatttggaagtcaatgattatagaaataaaaaagttgattattcaataggaaaagaaggtggaaaaataagattgttgtttgaagcagatgttcctccctttggttactccacatatcgtattaaacaagtaaagacaggtaaaagaacggtttcaggaagcgaaaagattataaatgaaggagaatatgtggttgaaaatgatatgtataaaattgtttttgacttgtcgaagggaggaattattaaaagccttgtagcaaaaaaagaagaaaacaaagaatttgccaaacaatcgggtgaatattctataggtgaattgagaggctatttttatgacgaaggcaagtttcgctcttctacagaagctccggctaagctgacggttttgcgaagtaatatacaagagacaaaggtaaaactggaagggaaaatagcttcacatccttttgtacagattataagcattgctcaaggggagaagcgtatcgattttgaccttactattaattggaagaaaaatgtaggtattggagaatataaagaaaatagttggcgggataatcgcagagcttattgtgatgacagatttaagttaagtgtacttttccctgtaaatcttcattctcctcgtatttataaaaatgcgccgtttgatgtttgtgaaagtaagttagatgatacttttttcaatagttgggatcagattaagcataacattattcttcattgggttgatttggcagaacaggaaggagattatgcattggctttattcgcagaccatactacttcctattcacacggaaaagattatccgttaggactgactgcccaatattctggtaatgggctttggggacctgactataagatcacgggaccgttgaaaatgaaatatgctattgttcctcatcgtggcaaatgggacaaggctgctatagccacgaagagcgattgttggaatgaaccattgttatgttcctatcattcatttgcaaaattggagtcaaggtcactggtagacttaaaaaataccggttatcaggtgagtgcagccaatataaaagatggaaaaataatcttgcgattgtttaatgcggaaggtgacaggaagcagcataatattacttttgatatgccgctgtctagtatagaagaagtagatctgaatggtagagttatagatagaaagacaataaaaacacgtaccggaaaatctgaaattagtatttctatgcctcgtttcggtctaaagacatttgctttgaacttgaattgaacatattctaataatagtaaactgtaatatttttatgtataaagctagcgctaatattttaatagcttgctcttttttgtggctgactgcttgttcttcagcaggagtagtaacagaagatttaattccgactgattatgtaaatccttttataggagctagtaccagtgtaggagctgccggtgtttatcatggattaggtaagacatttcctggcgctactactccttacggtatggtacaagtaagtcccaatactataaccggaggtgataatagttccggttatagtgatgaacacaaaaccattgaaggctttgcctttactcagatgagtggagtgggctggtttggggatttaggaaatttcctggtgatgcctacaacgggcgaactgcaaaaaatagcgggtaaagaagatggtagtataaaagggtatcgttcttcttatgataaagctaccgaaacagctaaagcgggatattattcggtagaactgactgattataagattaaagtagagagcagtgcgacacctcattgtggaatattgcaatttacttttccttcgaatgaacaatctcgtattcagatagacctggcacgtagagtgggagggacttctacttcgcaatatgtgaaagtattggatgattataccattcaaggctggatgaagtgtacacctgatgggggtggatggggaaatggtgagggaaattccgattacacagtttattattatgcacaatttagtaaaccactgagtaattatggcttttggagtgcggatattcctgatgaatgggttcggaagcgtgatgaagtggtaagtattccctatctgacacgtatatcacaagctccggtcattaaagataagaaagaactggaaggaaagcaccttggcttcttcacagagtttcccacaaaagagggagaacaggttgagatgaaagtaggcatttcctttgtcgatatggaaggagcagctaataactttaaacaggagattgcttctaaaaactttgctcaagtaaaacaggaagcgagtgatttgtggaataaagaacttagccgtatacggatatccggtggaactgatgacgaaaaaactgttttttatacatcattatatcatacgatgattgaccctcgaatctatacagatgttgatgggcgatatattggcggagataaaaaggtacatgaacaggacggtacatttaccaagcgtactatatttagtggttgggatgttttccgtagccagttccctttacaggcgatgattaatccgcgtttggtgagtgatgcgttgaattcgctgataacgatggcagatcagagcagacgggaatattatgaacgttgggaacttctgaattcttattctggctgtatgataggtaatcctgcactgtcggtgctggcagatgcttatatgaaaggaattcgcacgtatgatgtagaaaaagcatatcaatatgcagtcaacacgtcagctaagtttgggaatgattcgttgggatatactcctgaaccgttgagtatttcatatactctggaatatgcctatgcagactggtgcgtggctcaattggcaaaggcgttggggaaagaagaagatgcaaagcgcttttatgaaaaagggcaagcctatcgtaacatgttcgatgcggaaaaaggctggttccgtccccggaatgcagatggatcatggaaagcatggccggagaatgcactgaccgaagaatggtatggttgcattgagtcaaatgcttatcagcaaggctggtttgtgccgcacgatgttccgggaatggttgaactgatgggaggcaaggaagaggttatagctaatttgactaatttatttgaccacactccctctgatatgttatggaatgattattataatcatgctaatgaaccggtacattttgttcctttcctttttaatcagttggatgtaccttggtatacgcagaagtggacacgatatatttgtaaaaatgcttatgcgaacaaagtagaagggattgtgggcaatgaagatgtaggacagatgtcggcctggtatatattggctgcttccggcattcatccttcctgtcccggtaacacccgcatggaaataaccagtcctgtttttgacaaggtagaatttaatctggactcaaaatatcatcaagggaaagtatttacaattattgctcacaacaacaacacaaataatctatatatacaaaaagctttgctgaatggcaaggagtacaataaatgttaccttgactttgctgaaatcgcagcaggaggaacattggaattatttatgggcgataagcccaatacagaatggggtgttttatctaacatttaaataactgaatattatgatgaataagtttagacttcttttactagcatcaagtttgtttgtactgaatggaatagggcatgctcagacttctaccatgtcactgaacagttccaatcctaagatagtatgggaagtcaaaccgcaggcagatttgaataatatagggggagaacaaatctctacccccggttttaaaatgccggactatgtaaaaggcgtagttcccggagctgtttttacagcatatgttgaagccggaatcgttcccgatcctaattacgctgataatatatataaagtagatgagacgttttataaccgtcctttctggtatcgtacggagtttgaacttccggcatcttattcagcaggtaagcgtgtctggcttcattttgataataccaatcgtttcgccgatttctactttaacggagaaaaaatatcggggacaaagacatcgactaaagatgtgagcggacatatgttgcgttctaaatttgatgtgacacacttgattaagaaatcaggaaagaatgcggttgcggttctgattactgatcctgatcagaaaaagactcgtaaaggaaaagatccgtatggtgttgcttgtagtcccagctatctggcaggtgccggttgggattggatgccgtatgtgccgggacgtcttgccggaattacaggaaatgcttatctggctattacaggtgatgctgtgatggaagatccgtggattcgctcggaattgccgactttgcaacaagcagaactatttttctctacaggaatcaagaacgtttcttctgctccgaaagaagtggaagtttccggtgttattcagccgggaaatattactttctccaagaacattcgggtggaaggaaaagaaacagtacagttgtcggtggataagagcgattttgctgcattagtcattcgtaacccgaaactttggtggcctaacggctatggagaaccgaatctttatacctgtaaactgacttgttcggtagatggaaaaatatcggatgaaaaggatattacttttggtatcaagaagtatgagtataagatgatcaacaacgtagtgaattacccggtccttacattctttatcaatgggcagaagatttatctgaaaggtggaaactggggtatgagcgagtatttgcttcgttgtcatggcaaagagtacgaaacgaaaatcaagttgcataaagatatgaactacaacatgatccgtttgtggacaggttgtgtgactgatgatgaattctatgattattgcgataagtatggaatcatggtgtggaatgatttttggctgtatgtcgcttataatgatgtagctgagccggaagcattcaaagcaaatgctcttgataaagtgagacgtttaaggaatcatccttctatagctatctggtgtggtgctaatgaaacacatccggcacccgatttggataattatttgcgtgaaatgatagctcaggaagataaaaacgatcgaatgtataagtcttgttccaatcaagatggtttatccggaagcggatggtggggaaatcagccccctaagcaccattttgagacttcgggcagtaatctggcattcaataaacctgcttatccgtatggtatagatcatggttatggtatgcgtaccgaaataggaacggctactttcccgacatttgaaagtgtgaaattgtttattcctcaggagtcatggtggcctctgcctactgatgaacaattgaaagatgatgatgataacgtttggaataagcacttcttcggcaaagaagcgtccaatgccaatcctatcaattataagaaatcagtgaatacgcaattcggagaatcttcgagtctggaagagttctgtgagaaagctcagttgctgaatattgaagtaatgaaagggatgtatgaagcatggaatgataagatgtggaatgatgcggcagggcttttgatctggatgagtcacccggcatatccatcattcgtgtggcagacgtacgattattattatgatcctaccggagcttattggggagcaaagaaggcttgcgaacatcttcatcttcagtggaactcatctaataacagtataaaagctgtaaatactactaccaaagacttgaaaggcgcttatgccaaagcgaccatctacaacctgaacggaaaagaggttgcggcatatggacgtacaaaacagatggatgtaccggcaagtaacattgcagaagcgttcacgttaaacttcaatccgtacaatttggcttttggcaagaatgtgatagcttcttcatcatcaccatccagatcggcttctttagtagctgacggaggggcaggcagtcgttgggaaagtgatgcgagtgactctcaatggatttatgttgacttgggtaagaaagaaaaaatagagcatgttgtgttgaaatgggaaacggcacgtgccaaagagtacgagatccaagtgtcgaatgatgcgaagaaatggaaaacagtctatacaaacaaagatggacaaggcagtacagatgagataaaactttctccggttactgcacgctatgtgaaaatggcaggagttagccgtgccacagactttggatattcactgtatgaatttgaaatatatggtaagaaacaaaagaatgttgaggaactgactccgctccatttcatccggttagaactgactgacgcaaatggtaatttgatttcagataatttctattggagaaacggcgtgacagatcttgactatacagctttgaatacattgccggaagcagaactgtcgtgcaaattagttgataagtcaatgttatccgaagggaagatgaaattgtcggtaaagaatcattcgaaaactgttgcttgtgctaaccggataagattggtgaatacggctacacaagaaagaatccttcctgttatcatgtctgataattatataactttgatgccgggtgaagagcggactatttctgttgaggcggaaccggaaatgttgaaaggaggagtcagtgttttgctaaaacaatatggtaaggctgaacaaaagaagttggatatatgatatacgtagaaaactaaggggcacctttttaatttgaacaccagaagacattacctgtcctgtcttctggtgtttttaatttccctctatattgtgcctgatatattcaggaagagtagaaagtgaactttcttttttgaataacctgcttgatttaatagacaatgatcagtttattaatctattatgtgtacttgcttaatatcttttggaactaacaacagttcgtttcacatacgtggtcctatcgcttcacatacgtgatcccattagctcacgtacgtagaccgaacgctccacgtacgtgaaactaagaaatgttactgacaaagtttattagtcttgccttcttcatatattaatgttaccgacatttgttttatttgtaccatgataaatagtcctatgtatgaacagaatgaagaaaataaggctttagagttgaataaataagtgagcatacttgatttgtagtgggataggggtgacaatagaaacttataaaattctattatcacccttattatcaccagttattatcaccattacttgtttgattgatagctgtttatctttaaaaagtgacaagtgacaataaaaaactgtttttttcttagtgggagttacttgaaaaataaaacatttattttagtggttaagtaaacttgaatcgtcttttttaataagattcttttttattcaaagttggaaaagagaatgttttgcccaaatatatcttcttatttataggagacagtatggggcttggccatattatggcaacggaagaatatcttagaaccaatgaatttgaacttctccttatgtttggatttcctaatgtcggaataatggccacattctccgcttcatctcctataacagattcagcagcagctggaacagctttggcatgtgggcataaggccaatagatgagtttggaaatatatacaagaaaaaatgtatagaacacaaaaataatgaaatcaatcaataactaatcattatcttatgagtgcattaacaagaaaattaattttgctgctcgtggtttgcataactgcaatcggagcagcagcacagacaagaacgcttagcggtgaagttgtcgaaaaaagcggagacccgttagtgggtgtcagtgtattcaatcgagaatacaagatagggacaacgactgacatagatggcaagtttgaaatcacacttccctccggcgtaaaaaaactgactttctcctatataggctttcaacctttggaaatagatttgaagcctgacgagaataaaataaccgttacaatgactgaagacgctcaagctcttgatgaggtcgtagtggtgggctatggcacacaaaaaaaggttaatctcacaggagcggtctcggtaattacagataaggagctttccgatcgtccgtcccagtcacttacctcaatgcttcaaggtacgactcctggacttaacatcacgacgggttccggtcttccgaacaaatctccatcaatcaatgtacgtggtaccacttcagtaaatgccaccaatcctctcgtcctggtagatggtgttgaaagtgatcttagccaagtcaacccaagcgatgtcaagagtatttcagttatcaaagatgcttcagccgcagccatatatggagctcgtgccgcatttggtgttattttggtcaccactaaggctggagagagcgatgatgcaacagggaaaagagccaggactacagttcgatacagtggcagattcggctgggaggcaaacaccaacagtacagattatgaggaccgtggttattgggctgtctatactgccaacttatttgccagagctaaagacggtaaaaatatcatagactacacagataaggatatggctgagttactggcacgtgtcaacgaccgtacagaacacccggatcgtccgtggatagttgaagatgtacgtaatggaaaaaaacagtgggtatattatggaaattatgaccattatcacatgaatttcagtgataaccggcctaaaatgcagcataatatatcactgtcaggcggcattggcgatgtaaattacttcgtatccggagcgtatgaataccgtaaaggcatcttgaaagttaatcctgatacctataacaaatataatcttcggtctaaaatagagtttcctgttacaaaatgggcgcgattttccaataacacatcactttactctacttcctataaatctcagggaaacggcagtatagaagacacattcggatattctgcaaatggtgcatttgcatgttatcccaacaagaatccggatggaacatggatatactcagtaccttatcagagtacaaaaatggcaaatggccgtcatattatgattggagagggctcacatcgtaatcttgaacgcaatatgagttttataaatacttcccgttttatagtaacccctatcaagcaattaagtattacaggcgatttttcatacaaatttgatcaggaccgtaattattggcgttcaaatcatttgaatttcaggatgtatcctgattccgaaatggacttttacggtattggggccggccaaaacaaacttactgaacaggtttatacatcgaactatatatctgtaaatgcctatgcaaattataatcaaagctggaatgataaacataatttagccgcaacatttggtttcaattatgaacattggcataaaaaaaatcttagtgcagtaggttatgagttatcatcagatgacctcgatgacttgaatctcgcaacaaccatgttttcaatgggaggtggtcagaacgaatacaagcttgcaggatggttcggacgtgtcaactatgattatgacggacgttattttgctgagattagcggacgttatgatggtacttcccgttttgcttccaataaccgttggggatgcttcccttccggttccgtaggctggagaatatccgaagaaaaattcatggaatgggcacgcccgtcacttagcaatctgaaattcagggtttcatacggaagtctgggaaaccagaacgtatcttctttttatacgttccttcgtatgattactctcagtgactttgacacattcaactttggttctgatacaaaggcgaaatattcgtctatcggagcacccatagcacaaaaccttacttgggaaacggcacgtcagtggaatattggtgcagatctagcgatgttcaacaatcgtttgaattttaccggagacatttatgtgcgaaataccgttaatatgcttaccgatggtattgagcttcccggagtatatggtgccactcctccgcagatgaacacggcggacttgcggacaaaaggatatgaactttctgccacatggcatgataatttgaagatattcggtcacaacctttcttattctgtttctgccaatctcagtaattatgatgcacggataacacgttatgataatcctgagaaagtatttgcaaagagctactatccgggcatgaaacttggtgaaatatggggttatcatgtagatggtctgtttgcttctgatgaagaggcagcccaatattcatcccaggtagatcttggagttgttgccaagaatcttcctcaaggaacatggagggcaggtgatcttaaatttgctgatcttgatggggatggtaagatatctgtaggtgaggactctgctttgaatccgggtgatatgaaaatcatcggaaacgaacttcctaccctccagtatggattctctggctccctaaactatatgggatttgatatttatgccttcttccaaggaaccggcaaccactattggtatccaaatggctataattaccaattttggggttcattttcggatcctgtggcaggatatataccacgtaactttatcgaccaatgttggtcgaaggacaacccgggtgcatattttccccgccctctcggacagtcagcaaaaaatggtcagttaagctttgtaaatgacaggtatcttcagaatatccgctatatgcgtttcaaaaatctgacaataggatattctatccccggaaaaatactttcaaaagtatcaatccaacaattgcgcgtatatttcacagccgagaatctgtgttactggtctcccataaagaaacattccaaatatattgatccggaagccgccttcagtcgcagcagcaatcaacttaatgcgatgtattatccttgggcaaaaacctatatgttcggaattgatataacattataattaacagagaatatgaaaataataaaatatctggttttcaccgtagctgtcactctgatgtgtgggtgcaacgatgatcttgaccttctgccgaaggacagaatgtcatcggaagaatatttccgtacagcttcagacctggagctcttcacgaatcctttatataataacatccttcccaaagttcaatacaaggatcagagcgacatttatgtatgtcagtcgctctccaatgagctgatggggggctcctatcgtaccgtccccgcttcaggcggtggatggtcatggacagacctcagacgtatcaacactttgcttggcaacattgacaaatgcgaagattccgatgccgccgaaaaatattcggctgtcgccagattcttccgtgcgtacttctatgctgacaaaatcgaacgatttggcgatgtgccttggtacgataccgaactaagcgatactgatcctgaactctacaagcctcgcgattcccgcgagttagtgatgcagaaaatgctggaggatctcgatttcgcaatcgaacatcttccctcccgcaacaatgaggctgaagccccctataaagtaaccaaaggtgctgctctcgctttcaaaagcagagtatgtctgtttgaaggtacttatcgtaagtatcacaacttacggattgaaggacatgacgcagactattacttggcccaatcggctgatgcagcaggcaagctgattgacagtggtgaatattcgctttattctaccggctctccttctaccgactacaatattctctttgcagaggatgatgccaatccgaacgaatatatcctggccattagctaccgctatgcaatctttaacaattcacatggatcaaacgcacacatgttgttgagtaatcaaggacgtcccggctatacccgcaagatggtttgtatgtatcttaattcagatggaacccgatttactgaccgtcccggttgggagacgatgggatttaatgaagagactgtaaaccgtgacccccgtttggctcagtctatacgtactcccggttatacacgaatcggaaagaaagagattctcgctccggatctcggcgttgcaatcacgggatatcaacctatcaaattcgtacaagatcccacggctgccggaggcaataccgacagggcaagctattcagtaaatgatttacctgtcatcagatatgctgaagtccttctgaattatgcagaggcaaaggccgaactggggacattgacgcagtcggatcttgaccgctccgtaaatctgctacgtggtcgtgtcggtatgctcgggattgacatggggatgtcgaacgctatccctgatccatatctttgcgaccctaaaaccggtttcccaaatgtgaatggtgccaacaaaggtgtcatacttgaaatacgtcgtgagcgtaccgttgaactcgtacaggaaggcttccgttggtctgaccttatgcgatggaaagcaggatatgcaataaatgactctgatgataaatcattttctccatttatgggaatgtatattgcaggagctggagaatatgacttatccggtgatgggaaagttgacgtgattttttataatcagggtactcctaaacccaatgccggagttggagttcaggtatatgctctcggaaaggatatattgttgtcaaataatgatcatggctacatatattaccacaggagtgttccaagagttaacttcaatgaacaaagagattatctttacccaattcctatccatgaacgctcgctgaataatagcttgacacagaatcctggatgggatgatggtttaggtttttgataatcttaaattcttcatataaaacaatgaaacaacttataattattaccttcatctttcttgttggtcaagtaaaagcatcagggcaaacatattacaccgaggctacaaatagtgatatgttacatcaggcaaatcgtacaggagcctccactcgcgtcgagttcatacttcccgattccatcgaaggatatattccactgaaggcggatcttcatcttcatacatacttttctgacggacatctgtcgccgtctgctcgtgtccgagaagcttggctcgatggtcttgatgctatttcagtgactgatcacattgaatatcatcccgccgatactgatatgataggttatctaggagctacactccctgatggtatcgaggctcataatgtgaataaaaaaactaatgttaaaccaaagcaagatctgaacaaatctgttgaacttaccaagaaagctgccgtcagctatggtctgcttattattcccggtatagaaatcacacgtgagccaaaaggtatcgggcactataacgctctgttcacaacagataacaatggcatatatgacccggatcctctcaccgcaattcgcaacgccaaagctcagggagctttggtgatgcataatcatcccggttggcgccgtgaatcgattcaacacccagattttgaactaaaagcatacggcgaagggcttattgacggaatagaagccaacaatggcacagcattttgtcccggaactatagaccgagcaaaagaagacaacttattcgtagcatcgacgaccgaccttcacgatacatcgtttgaggaatatattggtagaggactacgtcgggacatgacgataatcttagctaaggaccgttcacttgatgcaatgagagatgctcttgaaaatagacgtaccatcggatatggtgcaggagggacattaatgggacaggaataccttttacgtcaactttttatgagttgtgtttccatctctcccgtaaatggtcataatatccaactcaagaatcctacttctttgcgttttatcattcatccggatggaaaaaatcctattgtactccctgaatttagctcaataattttgtctgacaaggaccgcgggttctctgtagataatgcatggacaggagctgattcatttttaagaatatcattataatcaaactgagataatgaaaaagtcaataaatatcctattttttacgttgatgcttgcggttttttctgcttgcatcaacgataatgagccgataatggcaaaagctgtactctcaagtacagaaaatctttctttcgagtcaactgatgctgagagcctgataatcaccatatatgctgatgctgaatggagagtcgatacgcctgactagattactgttactccttcaaatggtgtcggactcacagacgtgaccgtttgcgttaaggataattatagtgatggagaagttgacagtccacgcacagacaaaatagtctttcatgagtcaaaactctccagctatgcctatgttatcgtctctcaagaaggcgactgttatcgaggaatctctgaaatttcagtgaaagctatattctctactgacgatcattcatttattatagtgaaagacgctgtcgtcaacatagtaagtggaaacagtatgattatttctgataagttcagtcttgaagcaatgtgtgcgactactattactgatgtcaaagccggagatgaaatcattttgtatgggcaaaaacttactgatgaaaactcctgtgtgacgataaagacagaccgagtagatataatctcatcaggaaatttcataaaatatcccaattcgacagatatttacgactttgacaataaaatagatgaatggtcattcataatagttgaaggagtagttaacggtaacaccattgaattgaatgataagtcaacattttaggttaagaccatcttattggaatctaatttaaatggggatattcccaaaataagaaaaattaaggcaactaatttattgcgagttagttgcttttttgtatctttaagcattgcccccaaaaacggtttgacggccaaaacgggggtaatctaaactaaaaacacatggtaaagatacaaaaaatctccggaatcgaaccttgtttaggttttaccgagttcgatatgctaaaaaatatcgtcaaagttttgcaacgagtgaattaggtcgactccatgctctcttccctttttcggaactggtccgacaaatgcatttgaagtcttctcctttgggtcgtaaaagttatttttctcccgaaggtaaaatagccttgatggtcctgaagtcctataccaacttttccgatgcacaactgattgaacatttaaacggtaatattcattaccagttgttttgtggtgttcagattgatccgcttcatccgctgaccaatcctaaaatcgtcagtgcgatccgccagttcctgacgaatcgccttgatgttgagtccctccagcttattcttgccgggcattggaaaccttatcttgagaaccttcatgtctgtatgacggatgccacctgttatgaaagccgtctgcgtttccctactgataccaaactcttatgggaaggtatcgtatggcttcatcgtcatctgtgcaaacattgccggagattgcacatacaacgtccccgtaacaagtatcttgatgtaagccgtgcctaccttgtttacagtaaactgcgtaaacgcaggaaatcacagacccgtatgattacacgcgggctacttcagttgttggaaaagttgcttgaccagctggagcggattcattcatcctacgggaacaggcttacactatcctctgattaccaaagacgattctcggtcatacagacggttcttgagcaagggaagaatttatttgcaggccaaaaagtgtccgaccgtatcgtgagtatcgaccggcattaccttcgccccattatcagaggcaaggaaaccaaatccgttgaattcggagccaaggtcaacaatatacagatagatggaatctcctttatagaacatatctcctttaaggcttttaacgaaggagtacgtttgaaagactgtattcatctgcaacaacaactgaccaaggttagggttaaggcgcttgcagcggattcaatctatgccaataatgccaaccggaaattttgtactaaatattatataagtacttccttcaagcgtaagggtagagccgccaaagatgagccgcttcggaagatcttacggtcggaactcagccgtgaaagagttacccggctggaaggaagctttggaacgcagaaacaacattactcactggccaggataaaagccagaaacaggaaaacggaaatgctttggattttctttgggatacatacggccaatgcggtatgcatgatagaaaaggtcgaaaagaaaaaaagaaaggcagcataatctgactaaaataagaggaaaagaggagaggttttaacttccactaaaaaaagatatatacataatgcatgggtgggaagaaaaaataagaatatgtaaataatgttctatgaaaaagatagaagactgggagaattgaacgaaaaaatcaagagaaaagctcacgtaaagtaaaacttttctcttaatttagaagaaagaggaacatttactgaatatccctaaatggacaccttatcagagttaccggttactatgcgggtcatacttcgtcagtttcattcataatccccgttattattgaggataaaggcaggtcaggctattctgcaatttttgtaaaatacttaattataaacgatttacgtttaattatcaccattctgttttttactgtatttttaaatattacttacacaagtaaacacatcctgccgtgatggtgtaactatgatcacagtatagtgtcactatgagaggaggatagtgacaccattttttgtatggtttatagaggtgtatgtatcatattattttttatatttgcaaatccaatcgtttgtatacaaagataaaagcagagttatgaataatcttcgaatcttattatacgtggttgtcctttcactggctgcatgccatccggaagggactaatgtaaaacagggattagacaaagccgcacagctaatggggcaggacccggatacagcatctattattctcgaaaatatccagatcaaccagatgaacgaagcacagctggcagaatataatctgttgtgtacccagctgaatgaagataaaaatatcgcccatacgtctgataagcaaatccgtcaggcagtttcatactttgaccaacacggcaatgaacttcagaaatcaaaggcttatttttatctggcatgcgtagagagtgatcttgaccagaaaaaggaagcggagacccacttcaaggaagcaataaagcttgctgctcttacagagaagtacgattatgtagccaaggtgtgcagacgttgcagcctttattatcagaaatatggtcatttcgacgaagcattggaaatggaaagaaaagcctatgccagccagctaatgctgaacgatcagacaggcgatacgaagattattctttcttctgcattgggagtctttggtgtgatgtccttgttactcgggctgctctggaagaagaataagtttgtatattctcaactgactacttttaaagatgaaatgttgcgaaaagaggcagagtcggataaactgatgttgcaatgtaactatctggaagaaaaatatcagtcgcttcaacagcatatttatgaaagttctccggtagtatcgaaagtccggcaaataaaagaacggtctgtttccccttccaaggttgtttctttttcagagaaagactggagtgaattattaagactacaggaaggagtatatggacttgtttccaaattgaaagagataagtcctaaacttacagaagaagatttgagagtatgtgctttcctgcgcgaaggtatccagcctgcttgctttgcagatctaatgaaactgactgtagaaactcttacccgaagaatatccagaataaaaacggagaaacttatgcttgtaagttccaaagaatcactggaagactacatcaaatcattgtagtccacatttgtccggaattacctgacaaaaagctttgtttttcaacaccttatagaaatgggatgtccgtatccgtccggctaaaaatgcctgttttatatcactgttctataactttgcaaacaaaaaagttacagaactatgaactacttattatttaaaagatggaatgatttcagtggttggcttgtcttcctgatagcagctttcgtatacggaatgacaatcgaacctactgccagtttttgggattgtcctgagtttatttcatgcgccgaaaagttacaggtcggacatccgcctggtgcacctttttatatgctggtaggtaatctgtttacacagtttgcctccgatccctcccaggtctcacgtacagtcaactttctgaatgcactgctaagtgcaggatgtatcctctttcttttttggagtatcactcgcctggtcagatctcttctgaaagaagaaaaagagaatctgtcagtaaccgacgtgattatcattctcggttccgggttggtaggagctttggcatatacttttagtgatactttctggttcagcgcagtagagggagaagtatatgctttctcttcttttcttactgccttggttttttggatgattctgcgctggcaggatgagtcggacaccgtttatggtgaccgatggattattctgattgcctatataatcggactctccatcggagtacatctgctcaatctgctttgcattccagcgattgtactggttttctattatcagaaatatcgaacgatttcgcttaaaggagcaattgcggcgattgctttatccggtctgcttattgtattgatactttttgtctacattcccggaatggcggatattggaggatggttcgaactactctttgtcaatgccttgggatttcctttccaaacaggactgattggctttctggctatcacatttttcctgctcatagctggtatctatcgtttcaaaaaacgattaatcaatacagctttatggtgcatacttatgcttaccgtaggttataccacctatgcagtgatattgattcgtgccaatgccaatacaccgctcaatgaaaatgctccggataatattttcgcactcaaaagctatttgaaccgggagcaatacgaaagcgcccctttactttatggcaaaacgtatgcctccgaaccggagtatgtgcccgaaggagattattacaaggtaaaaatgaaaacgggtggtgctgtctacagaccgaatagggaagaagggaaatataaagtgattcgaaataaagaggaagtatgctatactcaaaatatgctgttttcacgaatgtggaatgatcgcatggcttcctcctacaaaagctggtcggaaggaacggacggagctcccacgcaaaaagagaatcttacctacttcttcgcttatcagctcaattatatgtattggcgctattttctctggaattttgtcgggcgtcaaaatgatatccagggacatggcgaaccggagcatggaaactggatcacgggtattcctctgttagataatctaaggcttggtgatcaggaacttttacccgaatctctgcgtcagaataaagggcataacgtattttacgctttgccgctattattgggattaatcgggatttactggcaatggatgcggggaaagaaggggatgcaacagtttagcgtcgtgtttttccttttcttcatgacaggtctggctattgtgctatatttgaaccagactcccggtcagccccgtgaacgggattatgcatacgcaggttcattctatgcttttgctatttggataggaatgggagctgccggattgtgtgacgcacttcgaaaaaagaagtcgtcagtacttcaagtcggcctgttaatgtttctctgcctgctgattccggttcagatggctagtcagacgtgggatgatcatgaccggagcaatcgtttcacctgccgtgattttggagccaattatctgatgacactccccgacaaaggaaatcctatcattttcagtaacggagataatgatacttttcccttgtggtataatcaggacacggaaggagtacgcagagatgcccgcatctgcaatttgagttatgcgcaaacagattggtatatttatcagcagcaatgcccgttgtatgatgcacccggattacccattacctggagtaaagatcaatatcaggaaggaaaaaacgaatacgtagccatccgaccggaactgaaaaaacagatagaagagctttatcagaaacatccggaagaagcccgtgatagtttcggcaatgatccgtttgaggtaaaaaacatcttgaagtactgggcattatcggagaaacaggacttccacgtaatccctaccgatacgatcagtatcagcattgataaagatgcagtgcttcgatcaggcataatgcttcccgactccatccgtcatctgaaaggtaaagaactaaaaaatgcgataccggataagatctatatttctctgaaagatatgcgtattctaaccaaggtagatatgctgatgctggaaatgcttgccaactgcaattgggaacgcccattgtacatggcaatatccgtcggtgaggtcagcaagctgaagtttgatcattatttcgttcaggaaggattagctttccgtttcacgccttttgattataaaaaatggggaaatgtcaaaggagataataactatgcgatagatgtagagagattgtatgaaaatgtaatgaacagatataagtatggcggactggacactcccggactctatctggatgaaaccaccctgcgaacctgctattatcatcgaaggcttttcgcccaactggcaaaggaactgatcaggcagggcgacaatacccgagcaaggaaagtacttgcctatgcagaacaagctgttccggcgtacaatgtccccgagatctatgaaagcgggtcattcgacatagccaaagcctatgctgccctaggagaaaagacgaaagcaatgcctctgttaaagaacctgacagccgaatcggaagattacatcaactgggcattctcattaggagacaacaggatcaatatggttcagagagattgcctgtataagttctggcaatggaatcagtataatgaacttgtaaaagagattgatgaagaggaatacaggctaagtaatcagcgctttgaggagaaatatgctttattctctcaaatcgtgggacttagaaactaaaatccggaaatataaacttgaaaacaataaaactatcagaagtatgagaaatgcattgagtaaaataaattatattattctatcgattggttcgatattgattatcacaggatatgtattaatgagcggcgaggggagtacccctgccgcatataatcctgatatcttcagcagacttcgtatatgttttgcacccattatttgtttactcggttatttgctgaatgtggttggcattatttatattacaaaaaagaataattagcagggatacatcttaaatattttcaaaagaatgcgtttttaagccaaataattacttcttttgtcctcactaataaaaatgaaagtcggacaacatgagtaataacattgacataaaaacgcttgaagccttccaggatggaaatcacaaggcttttgaaacagtttttatagcctattacaataaaacaaaggctttcatcgacggatatataaaatcggaatcggatgccgaagaattgacagaagacctttttgtcaacctttggatcaatcatgattcaattgatgcatccaagtcttttagttcttatctgcatacaattgcccgtaattcggccataaatttcttgaaacataagtatgtacatgacacttatctaaatagtagtcaggagatcgaatatagttctacctccgaagaagatcttattgctaaagagttaggcttattaatagatgacattgtcggaaaaatgtcggaacagcggaaaatgatctatacattaagccgtcaggaagggttgagcaatgctgagatagcaatacagctcaacaccactaaaagaaatgtcgaaagtcagttaagcctcgcattaaaggagatacggaaagctatctcgtgctttttattatcttttttataaaaacatccactttttcattgagctttttgtcatcagactgtatatatagtaaatacagcaaaaatggaaaagagtaatattatcaccagaatcatcaaaaagttcctttccggacgtttttctgttgaaacggaggaaaaggtacagcgatggattatgaaggaagaaaacgcggaggagaaagaaaaagcctcattagagtattggaacgaactggatacggaagccgattcaaaaacatacagtgctttagagcgggtcaatttaagaaccggatacaacaaagaacatcttgaaaatattgttttatatcataagtttgtccgcattgtagccgtcgttattcccatatgcttattggcaggaggattgctttattatatcccttccgaaaacgagcagatagaaatatccacagcctatggcgaacaaaagcgcttggttctgccggatagttccgaagtatggctgaacgctggaagtacaattacctatccgaaaacttttaccaaagagaatcgtgtcgtaacccttgatggtgaagcctatttctcagtcagaaaagatgatgcaaaacctttcatagtagaaacatcgcaactatccgtcaaggtacttggaacgaagttcaatgtaaaggcatatgctaatgatgcgaatattaccacaacgttgactagtggaaaagtggaagtgagtacgcaatcccgtcctcctcaaactctcaagcccaacgaacaactcacctatgataaatcgacatcagatattgagatatcgacagtagacactgttgacacgaacagttgggtaaaagggaaaataatcttcaccaatgctactgccgaagaaatattcagaacgctggaacgacgttatgatactgttatcgatcattctaccgatttttctgcctctagacggtacactgtcaaattcctgaaagatgagaatctggatgaaatgctgaatatattaggagatataatcggctttagctatcggcagagtggaaacaaaataataataaccaaataaaaaaaatagcctatgaacaaaaagaaccgggaagcagcttgagaccctcttcccagttctgaaatgtctatcctcatttaaaccgcgaagtaaaaacgaagtatcaacgtacaaatataaaataatgaatcgaattaatgcgaataaaaaaccagataagatgatcattcttttgtttttttctattctgtcattgacggcaatttcccaaaatgcagaaaagaaaattacaattcaaaataaaaatatctctttaaaagaagcctttgagcaaatagaactacaaacagactatagcatagcttacgaacagtcaaacctgaacctgaaaaagaggcaagcattgtcgctaaagtccgcaagcattgagaaggcactaacacaaatattgaaaggtaccggatacatatacaaaataaagggatatcatattattatctctctgccgacaccaaaaacagaaacaatcggcgaaaagacacaaaaactaacgcaaaccataagaggaattgtagtcgattccaaaactaatgctccaatagagtatgcctctgtctatgtcttagaggaaccttccttgaatagctccacagatagtctgggaaacttcagaatcagcaatgttcctattggacgctacaatattcaagcgtcttttacgggatatcacataagcataatcagtgaggtatccgtaacttcatccaaagaagtatatgtagaaattccgatggacgagaatatccaatatctggcagaagtcctcgtgaagccggaaataaagaaaaaccggacgatcaatcctatggctatcacaggcggccgtatgatcagcatggaagaagccggcagatttgccaacggcttcgatgaccctgcacgattaagtgccgctttcgcaggagtagcgggagacatcggcaccaatgccgtagccattcgcggaaactccccgcaattcacgcaatggaggctggaaggaattgagatacccaatccgactcattttgccgatttgtcgggattgggcggaggtttcctgtcagctctgagtacacaggtgatcggaaattcggatttttacaacggagcttttcccgcagaatataacaatgtattatcgggtgttttcgatatgcacctgcgcaatggaaataatcaaaagtacgaacacgcttttcaagtcggactaatgggtatcgatctgtcatcagagggaccaatcagtaaaaagcgaggaagttcttatctcgttaactatcgtttttcgactacatcactggctaccggcaatgacctgaatcttaaatatcaggatttagcattcaagctaaactttccgacctccaaagccggcaccttttctatttggggattaggattgattgacagaaacaaagctccaatagaagagcgttccaaatgggaaactctgggagaccgacaagcaggagaaaacagactagaaaaaatggtgggaggacttgcacacaagtatgtgatgaatgaaaacacgtatatccgctcttccctgtctgctacttattccaaagatcatacagtggtagatcaacaagcagatgacaaactaatcagagtaggagatatccggaacagcaggtgggacttcgtttttaattcttatctgaatacgaagttcagtccgagacatactaacagaacgggggttacgattacaaaccttcactatgatcttgattatcaggtcagccgttatttcggattaaacagacctatggaacagatttcaaaaggtgatggtgaaagcacagtcttttcggcctatagcagttcggttatcaatctgaataataactgggacactagcttaggagtaacagcccaatattttactttgaacaataacttatccatcgaaccgcgggttgccctaaaatggaaaataaatccgaaacattctttggcgttggcctatggattacatagtcgcagggaaaagctggattattattttgtagaaaaggtcgtcaacggcaagaaccagtcaaatcgatatctggatttttcccgggcacatcatgtcgggatgacatacgactggaatatcaatcaaaacctgcatttaaagatagagccttatttccaatatttatttcgtataccggttgaaaagaactcctccttctcggtcattaaccatgaggaattttatttggacagaatcttgaccaacaccggtcaaggcagaaattatggaatagacatcacgctggaacaatatatgaaaaatggcttctactatatgattacaggttctttgtttaaatcgaaatataggggaggagataacgtttggcgtaatacaagactggataagaactatctgctgaacttacttgccggaaaagaatggatggtcggcaaacttaaacaaaacgtactgagtctcaacggacgtttattctttcagggaggggaacgctacacccccgtaaacgaagaaagaagtcagacagagcatgacatcttttttgatgaaacgaaagcatacagcaaaagattcaatccttcccttccataaacggtgatgtttctgtcagtttccggataaataagaaaagagtatctcatgagttctcattgaagattctgaatgtaggtatgcgcaccggaatgcacttttaccaatacaatgaaaagacctttgaaattgaagaaaaagaaggaacagggttaattcccaatataagttataagatttatttctagacaaactaaaatcctaaatgtcttaaagtaatcattatgctctgtcattcagacctcccgttaccaagggaaatgttctgaatgacagaaactcttatgtacaatgaatagcaatcaaaacaagaacggtatatcgaacggttcgcttcattatatattcatattagtttaagtgtcacaaaaataatcaatattataacagaaaggcgaagcaaatgataaaaaaagcaattttgaatgaaaagatatacatggatgaataaaagcatatgctcctgattccttgaaataccctaagtttgtatcctgaaaaccgaacggaaagtgtgcttcacaattatatatagccatttacacctttgaatctataatatttaaaacaattaatcacatgagagaaaaagccaaaagcccttaagtcaaattgaaatcaattagaatctattaaaccttatttaaatagaaagcctaaaagaccttttttcaaactaataaaatcttatagaaaaacatgcgtaaatcatttaatctaatctggatggttttcggcttcctgctactaatagtaggttgtaatgaagacaagaaaagcacagctttcgatcctaatcaaccagtcaagtttacagagtttatgcccgattccggtggcatacgaaccaaattcattgttaaaggctccaatttcggagaagacaaaagccaagtgaaagtttacttcaaggatgaagtaggtaatgagcgggaggcattggttttaggtgtcaagcctgatgttatttatgcccaagtgcccaagcaagccggaggggaaagccatgtacgggtggagattgccggaaaagaagctgaactcagcaatgctgaaaaaaccttcaaatatattgtaacttcttccgtatctacagtagtaggaaaagccaaagaaggtggcaataaagacggaactctcggcgagaccacattcaatactccaaggtatgtagctgtagataatgatgacaatgtattcatattcgactctgatggaagaacgcgtttatcatccatcgaacaaaataaaacgatcactttactagatggcatggtaatcgaccaacctttatttattgataaagaaaagaaacaactatttggtccatgcgataatgccaacttcggttgtttcttattcgatgctaatgtgagctgggtggctgataaaatgggacagcttttagccaacggaggatggatgcatagtgttgttctcgaccccgtagattctacttttgtgatataccgccaaaatacagggcaattgtggacacaacctttcgataaaaatagaagaacattaaatcccaacaaagcaaaacgaatcggtacactctataatacaggttccaatggattatgtgcttacaatccggttgataagtatgtttactgtgtgttgcatagtaaaagtgcagtttatcgctttaagctcacacgcgatgcggacggttggccagccctagatggggacatcgatgaatatatccccggtgcaggcgcaggcttccgggacggagatgtgcaagaagcacagtttaaagaaccacgtggaattgctattgataaagaagggaacttatacatagccgatgttggtaataaccgaatacgcaaagttgacaccaaattgaacgtcgtaaccacgatagcaggtagcggagctgcaggatacaaagatggagaccctttggaagcccaattcaatcagccctggggtgtctatttggacaaaaatgaatttctttacattgcagatcaaaacaaccactgcatcagaaaacttgctattgaataattaataaggaatagaaatgaaaacactatattttaaattagccctgtgtttctttctgctattggcaggaaatgcaacacaagggatatgggcccaacaagaaccaattcaaattgccggaatcgtgttagatgaacatggtgatccgctcccgggtgcaaacatatctgttaaagggaaagaaaaaaccggaactataacagatatggatggtaacttcagtatgaaatcattagctccaaaaacaacgctgattgtttcatttatgggatataagagcaaagaaatagtggttgctcaaaccgataagaagatgcgtatatctctggagcccgactcagaatcattggacgaagtagttgttgtaggtatgggaacacaacgtaaagtcagcgtggtaggtgctgtcaccagtgtcaatccggctgccatcagtgctccgtcaacttccgtagccaatatgctgggaggtgtggttcccggtattatagccgttgaccgaagcggcgaaccggggcaggatgtttctgagttctggattcgcggtatcagcacatttggtgccaaccagtctgcgctggttttgattgacggtattgaaggaaacctcaacgacctcgacccgtcggatattgagagcttctctatcttgaaagatgcttcggcaacagccgtttatggtgtacgtggtgcaaatggcgttgttttggtaacgacccgttccggtcaggaaggtcgaaccaaggtaacctggaaaagcagtatgactctctcttattccccccgtatgcccgaatatctggaagcatacgattatgccagcttggcaaacgaagcccgagtggtaagcaatatggaccctctttatagcccgacagaactggagattattaaagcaggactggataatgacttatatccaaacgttaactggcaaaaagagatactgaaagatgtaactatcaatcatcagcactatttaaatgtatccggtggtggaaaagttgccagatattttgtcagtgtaggaggtacattcaaagatgctatcttcaagcaagacaaagttaacaaatacaacacgaatgtcaaatgggctaaatataatttccgcgcaaaggtagacatgaacctaacttcatcgacgatcatgggattggctatggacggagctattgtagaagacagagcaccgggattcggaactaacaatgacgcactctgggccgcacaagcctatctgactcccctgacggtgcctttacgttattccaatggaatgcttcctgcttatgggaaaaacggagaacaaatctcaccatatatcttgttgaaccataccggatttaaaaagggaaaccggaccactatgaacatcaatttcaccttacgtcaagacttcgggaaatggatcaagggtttgactgccagaggaatgttctcgtataacaataacaatatacacaacgtagtccgctccaaaatgccggacctatacaaggcctttggccgttacaatgacggttcattaatgacacaacgtacggtatcagccagcaacattcaattcgccaagagtgctgccagtgaccggagatattacttcgaatcgcaacttgcctatgaaagacttttcaatcaggaacatcgtgtaaccggtttgatacattactatatgcaaagcaccgaaaccaccgaagcaaatgatgaaatttcatctattcccaaacgttatcaagcgttgtctgccagagccacttactcttataaagatgcttatctgatagaaggaaacgtaggatacaccggttccgaaaactttgaaccgggcaaacaattcggtttgttccctgcaatagccttaggatggatcccgacccaatacgaatttatgcagaatcatgcaggatggctcaactttttgaagatcagagcttcttatggtgaagttggtaacgatcagatcggtggtggacgtcggttcccatatctgacgttgattaactttggaggtggtagtcgttggggttccaatggattgacagaaaaacaaatcggagccaataacttacattgggaggtagccaagaaatataacctgggtatcgacttccaatttctcaatgataaaataggtggaacggtagatatcttcagagacactcgtgataatatcttccaggaaagaaaaatgatgccttcggaagtaggcgtcgtgaccaacccatataccaacgtaggacgtatgcgcagtagcggtatagatggtaacatttacctgaaccagaaaataaacgaagacaactctttcacggtgcgtgccaacatgacatatgctgtcagcaaagttgtacattgggaccaagatgcggtgcgctacccttaccaatcgtatagcgatgtaaattatggtgttatgcgcggtttggttgcattaggcttatttcaaaatcaggatgaaatcaaccgaagcccgaaacagacatacggcgaagtacgccccggagatatccgctataaagacgtgaacgctgacggaaaaattgacgatgacgatattgttcctattgcacactccaatgtaccgcaaattcaatacggttttgcactggagtacagatataaaagatggactatcagtgctttattcactggagcagccaaagttaacttcttatacggcggttccggattctatcccttctcaggcggagaagtcggcaacattctatccatcgtaaacgacccgaagaatcgttggacaccggcatggtattcaggggatccttctacagaaaacccgaatgcacgtttcccgcgcctgacttacggagagaataagaacaataaccgtgcttctactttctggctggcagatggttcttacctgcgttggaaatcattggatatttcctatcgtatcggaacgaataaagtactaaggacagtgggcatcagtgatatgaatctgcaatttgtcggacagaatctggcagtatgggattcagtgaaactatgggatccgggacaggcatctaaaaacggcgccgtatatccgctacagcgtactttctctttacagttaacagctacgttctaattgaaaactattatgaaaaagatattaaagaaaagccttcatattctatgcacgacactggggatcatcccgttcatgctgacttcatgcaactatctggcagttgatgaatactttaacgacctgactccactcgactccatctttgccagacaagattatctggagcgttatgtgtggggaactgcggcattaatgcccgctcaaggcaacttgttttccggttcctacggtccttacgagactgcggtagatgaagttcttctgtcatggcagaaagctgagtacgccggtacctacttgtacgcagacaaaattacgcaaaacgattcttactacaacatgtggggacaatactacaaaggtatccgtaagtgtaacactatcttcacccgcatcgatgaatgcaaagacctgaaaggattggacagacgtgaaattatgggtttgactcatttcatgagagcttccttctatttctatctgttggaactttacggaccggcagtcatccttcccgaagaaccgctgtcggtagatgaaaacattgaaaacttgtcattcgaacgtaacacgtacgatgaatgtgtggaatatatctgcaaagacctcgaagaagcttacagtctactggacccgacgcgcccgagcactcagttcgaacgtcctaccaaatatgcggcagccgccctcatgtcacgtgtccggctttaccaagcttccaagtggtacaacggcaatcaatattatgccgactggaccacttccgacggacgaaacatgatagcccagcaatatgacccggtgaaatgggcgaaatcagctgctgcctccaagagaattatcgatagcggtatttactcattatacactgtacccagcgatgaaaacacgtatgcatcctctcaggcgtcacaagcggaatttccgttaggagtaggaggaatcgatccttaccattcgtatatagacatgttcaatggagaagcactggctgtgaaaaaccctgaacttatttatgctactcccttgaacaacaacatcatttcaatcgccttcccgttgaaactaggaggatggaacggcttaggaatcactcagaaactcatagatgcctactacatgaaagatggagaagattatgtgcaacaacctgattattatgaagaagcgggtactgtacctaccatcgccacaggatatgagctgagaccaaccgttgccaaaatgtatctggaccgcgaaccgcgtttctacgcatctatcggattctgtgaatgtttctggcccgcaacttcggtaacaggaaccgaagctcccaacgtgactaactttacagcaggatattacgtgaatggcaactgtgcaaaacaggctgccaatccagaagactataacttaacgggatatactctaaagaaatatatccatccggaggataactgtaccagtcatacaggtgctaaaataaaaccgaaaacattccctgtattcagatatgcggaaatactgttgaactatgtagaagcattgaatgaactgaaaggagaaccggaatatacggaagcggcagataacaccacttatcatgttttgtataatccggaggaaatcatgtactacttcaacatgattcgttaccgtgccggattgccgggcatcacccttgccgatgccagcgatcaagtgaagatgcgtcagttaatcatccgcgaacgcatgatcgaatttgcgtgcgaaggaagaagatatcatgacctgcgtcgttggggactagcagaaacagaagaaaacaaaccggtacaaggtatggacgttaccaagaagacaaccgaaagagaccaattctatactgttgtcaatgtagttcataagtatgcattacgcagctttgacaggaagatgtacttctatcctattccgagagccgtattggataaaaatgccaaactgaaacaaaatccaggatgggacggattcggagattggtaactttcccctttctatcatataactgattattaatcatataaaattgaacatataatgagatcaatatacaaaatagtggtctgttctttgttaacgctctccatcacttcttgtgaaaaagacctgcttgaaaaagaacaatatcagaaagaaatctacctgatcggtgcttacaaccgagtatggaccacagaagtaagctacagtaacgaagaagtgaaaacttatttcacggtcagcagttccggtacattagcattagaccgagatgtgaacgtaaaaatgaagatcaacgaagagttggtagatatttacaataaaaaatactggaccgttctgaatgaggacaaatattataaatcactggatactgatttatattccattccttctttggagaatacggtaatcaagcacgctgaaggtatttccgccgaagttcctgtgttgataaagacagcaagtctgaagattgaccagtcatacgtcatccccgtcgaaatagaaagtacaacaggatatccgataagtgaatccggatataaaatgttgattctattaaaattaaagaatgactattcgggcagttaccagatgagtgggcataccaccttagaaggagaaactccgaagacgattcagaagcctaaaacgattaagcctaccggagtcaacactgtcagactattctatgccatgaacaacgagagcgacgagaaagctgatatccaaacgggtacaatagaactgaccatcacggatcagatagtggaaggcactaatgatgtaaagaaagttttgatcaaagcatgggatgctgaaaacggaccggtaattatcgactcaggagaaagtacctacaacacaaccgccaaaaagttcagcctcaaatatacgatcggtaacacgctatatgaagagcaactgaccaaagaaaaagaagttttataatacacgacaaatgaggagaagaggagatttcacggcattgcaaaaatgccgctgaaatctcctcttcgttttttcaacggaggacttgtttttacatgattccttgttttccttctgctaaattcgtaattttaccgccgattcacgcaataggggtgccctaacatgacaggctgagaacatacccatagaatctgatccgggtaatgccggcgtagagaacgaataaataagcaaatatggaaatgaattatctggagatattcggtacgtttatcggtattatctacctgtggctggagtatcgcgccagtatctatctgtggctggcgggcatcatcatgccggccatttatatctttgtttattacgacgcggggttgtatgccgacttcggcatcaacatctactatctgatagctgccatctacggatggttcttctggatgtggggacacggggaaaagaaaagtctccccattatacataccccgtggaaatgctatctgccactattccttgtgtttatcgtgtctttcgtcggcatcgcccggatacttatcgaatacacagacagtaacgttccgtggctggacagtttcacaacggcgttgagcattgtcggaatgtggatgctggcacgcaaatacatcgagcaatggtttgcctggattcttgtcgacatcgtctgttgcggactttatatctataaagatctctatttcacctccgcattgtacggactttactccattatagctatctttggctacttcaaatggaaaaaaataatgaacatgcaatgataaacgaacactatataccccaagccgtcatacttgccaacggtgaatatcctgcgcacgaacttcccctgcgtcttttggcagaagcccaattcgtcgtttgttgcgacggggccgccaatgaatatatttcccgcggacatactcccgacgtgattataggcgatggagactcgctcctgccggaatataaaaagcgtttttcctctattatccttcaaatttcggatcaggagacgaatgatcagaccaaagctgtccattatctgcaaagtaaagggatacggaaaatcgccatcgtaggtgctaccggcaaacgggaagatcatacattaggaaacatcagcctgctcgtggagtatatgagaagtggtatggaagtacggacagtcactgattacgggacgtttattccagtgagtgatacgcaaagttttgcctcatatcccggtcagcaggtctctatcatcaactttggagctaaaggattaaaagcagagggattgttttatccgctaagcgacttcaccaactggtggcagggaacgcttaatgaagcaatagcagatgagtttaccattcattgtacaggagaatatttagtattccttgcttattaaatccctgttccggaaaaatattctttcatctgccttactactgatagttttgtcttaccctggatttggttgactactataagtatcaactaaaatgaataaaagatgaaaaagagtgacatgacctttagtccttatcagcttgaacttcttggcgatttctatcgttcgaattgaatatgctggtacaatattctttctaatctattacatatataatattaggtatatataatatgagaagccgcctctgaacaatgttcgagacggcttctttaatataaaatcgtagcggattaatattagaacttatagtttacacttacaccaaacactttgtttgtacgactataaacatctttatccattgaagccatagccccatccaagccacgtggattttctttggtataatcgctgtaggtagtccagaaataagcaacatctaaacttaacgccttactaagattaatacgaccgcccaaaccgactgaataagaatcacaagagaaacttgtgtctgtctggaaagcatcgctcaatccataatcagttttctgataaccaccactgactgtgaatattttgtttatatcccattctacaccagccaggtattcgtgtgttccatgtttcaatgtcttctgcttgttatcagccatacctgcattcttgtcatcaaagaaatgatactctactgaagcacgaagagaaggcaagaattcataacttgctgctacagataacatagaagggaggtcacttggagtattcacaccatgctgataaggtgccatataggcagcagcagcatccggaaattccaatttatgtgtattgttctcaatattcatattagctttgaactcatacttcgcagccaaattcaacttaccgaacttagcgtctacaccgataatcggcgtcaatccccaacctgtctggtcacaatccagttcaagcttcgtatcattcagtttctgaagcataggtgcagattgttcttgtgcaatctgctgtgcctgttctaaactcaaattaggattagcccccataatttgttgtactatagcagcaccgatctgtcctgctactccttctttcaaggcaatattcagaaaacctttatatccacctgtaaagtaattcatacgggctccggcaaaaactgaaaagtgttcattaatcttatagcttgcccctaactgcaaaccataaatatattgacgaccttccatggctgaattgatattgtacatattaggtttcaacatatcacttgtagaatttaccaagccgatagcagctgcatcaaacataggcaaacctgtattgaaagaagcttttccaccaccaccaacgatagcgaaactaccggaaaatgcccagtcaccattcttatatacagcatgtacagaagggataacgggagccgaagcttttccttcataattgcgcacggaagtctgtccatccatagtccacaaaggacttgtagcagcaatatcacgagtctgatatgcactctgaatagtcagtgctacctgtaaaccgttttggggaaggaatgccagtccggcaggattactataaactccatcaatatcaatggaagcgccgcgggctatcatgcgcaagaaagcagcattctgattcgtattagttagataatctccggcaaaagttggaattgaaacgattaacattacaaatccaatcaagaaattttttctcatctaaatcttttttaaattaattcgggcgcaaagatacaatattcctgcacacgagacgtatgtttgtgcacttattttcgtttaccagctcattttgattgaaaataaaaactgtttctaatgaaacaattcacattcagagcggaggtaaagataaacaaaccaccctgtttttacgtttattaataagaataaaaacagaaaatattatggcctatacaattgcatttttcggaacaaagccttatgacgaagcttctttcaacgataaaaacaaagagttcagatttgaattccgttattataaaggacatctgaataagaataacgtgctattgacgcaaggagtagatgcggtctgtatctttgtcaacgatacggccgatgcagaagtcattcatgctatggcagccaacggagtaaaactgctggcactccgatgtgcaggattcaataatgtagacctgaacgctgccgccactgccggaatcaccgttgtacgggttcctgcatattcgccttatgccgttgccgaatataccgtagcactcatgctctctctcaaccgaaagattccacgcgcttcgtggcgtacaaaagacggaaacttttcccttcacggtctgatgggattcgacatgcacggtaagacggcaggtatcatcggtacaggaaaaatcgccaaaattctgattcatatcttaaagggattcggaatgaatatactggcttatgacctttatcccgactacaactttgccagggaagaacaaatcgtttatacttctctggacgaattgtaccatagttccgacattatttccctacattgcccacttaccgaagccaccaaatatctgatcaatgactactccatcagcaaaatgaaagacggagtcatgatcatcaataccggtcgtggacaattgattcacaccaatgccctgatcgaaggcttaaaaaacaagaaaatcggttctgccggattggatgtgtacgaggaagaaagcgaatatttctacgaagaccagtccgaccgcatcatcgacgacgacgtgcttgcccgtctgctctcatttaacaatgtgattgtcacttcgcatcaagcctttttcacacgtgaagcaatgggaaatatcgccatgaccacacttcagaatatcaaggatttcatcaaccacaagcctttgctaaatgaagtgaagagatagaacctttacctgacttcccttgttacagaagtatataaacaattagaaaaggagaaaattatgaagaaagtaatacataaagcagatacaagaggacattcccaatatgactggctggatagttaccataccttcagtttcgacgaatacttcgattctgaccgtataaacttcggtgccctccgcgtattgaatgacgacaaagtcgcccccggagaagggttccaaacccatccgcataaaaatatggagattatctccattccattgaaaggacatctgcaacatggtgacagcaagaaaaacagccgtatcatcactgtcggagagattcagacgatgagtgccggaacgggtattttccacagtgaagtgaatgccagccctgtagagccggtagaattcctgcaaatatggattatgccgagagagcggaatacacatcctgtctacaaggatttcagcatcaaagagctggaacgaccgaacgaactggcagtgattgtatcgcccgacggcagtactcccgcttcacttctacaagacacctggttttctatcggaaaggtggaagccggaaagaaactcggttatcacttgcaccaaagtcatggcggcgtatacattttcctgatcgaaggagaaatcgtagtagacggagaagtactgaaacgtcgcgacggaatgggcgtctatgatacgaaaagtttcgaactcgaaacattgaaggactcacatatcttattgatagaagtaccgatgtagaaatttggaattagaaatcatgaatcttgaatgaatgaagaatatagctgatatccggcaagaatataccaaaagcgggttaagggaaagcgaacttccctgcgacccgctttcacttttcagccgctggctacaggaagccatcgacgcaaacgtagaagaaccgaccgccatcattgtaggtaccgtatctcccgaaggcagaccctcgacccgtaccgtactgctgaaaggactgcatgacggaaagtttatcttctataccaactacgaaagccgcaaaggaaggcaactggcacaaaatccgtacatttcactttcctttgtctggcatgaacttgaaaggcaagtacacatcgaaggtactgccgcgaaagtttctccggaggaatcggacgaatatttccggaagcgcccttataaaagccgcatcggtgcacgtatttctccacaaagccagcctatcgcaagccggatgcaactgatacgcgctttcgtcaaagaagctgcccgatggctgggaaaagaagtggaacggcccgacaactggggcggatatgccgtcactcctacccgaatggagttttggcaaggacgccccaaccggttacacgatcgcttcctgtataccctaaagacggatggaaaatgggaaatcaatcgactttctccctgatttcactgatttttcttgccaactccaactagaatacgtaatattgcaactgtaaaaataatcagctcatgacactggattatatttatcatagcggttttgccatcgaagcagaaggtgtgaccgtcatcatcgattattacaaagattcttcggaaactgaacataaccggggaatcgtacatgactacctcctgcaaagaccgggtaaactctatgtattggccactcactttcaccccgaccacttcaaccgtgaaatactgacgtggaaagaagcacgtcccgacatccggtacattttctccaaagatattctgaaaagccatcgtgcaaagcccgaagacgctacctatattaaaaaaggagaaacctacgaagacgagacgatccgcatcgaagcattcggctcgaccgatgtcggcagttcgttcctgatccatctgcaagactggaacatcttccatgcaggcgatctgaacaactggcactggagtgaagaatctaccgaagcggagatacgaaaagccaacggagacttccttgcagaagttaaatatttaaaagaaaaagcaccgaagatcgatttagcgctgttcccagtggaccgcaggatgggaaaagattatatgaaaggtgcaaaacagttcatcgaacaaataaaaactactatatttgtacccatgcacttcagtgaagactacgaaggcggaaatgccctccgtgattttgccgaaaatgcaggatgccggtttgtcagcatcacccatcggggcgaaagttttgaaataaccaaataaacacaataataattatgaataagttaacaatcctgtttcttaccatgcttctcacatgcctgccaatggcaatgagagccgaatcgcacaaagaaaaaagagatgataccagataccttgcgggagctgttcctgtagtagatggtaaagtagtattttccaaggaattccagattcccggaatgagtcagaagcaaatctacgacactgtcatgaagtggatgaacgaacgtctgaaagaaaacaataatccggacagccgcgtcgttttcagcgatgaagcacaaggaaccatcgccggtgtaggtgaagaatggatcacattttactccagcgccctgtcattggaccgcacttgggtcaattatcagatcactgttacctgcaaactgggcagttgcttggtagaactggaaaaaatccgtttcacctaccgcgaaacagaaaaatacaaagcagaagaatggattacagatgaatatgcactgaacaaagctaaaaccaaactggtacgcggcttggctaaatggcgcagaaaaacggtagactttgccgatgacatctttatggatgtagctgtagccttcggtgctcccgatactcgtccgaagtctgagaaaaagaaaaaagaagaagaagcacagaaaccgtctatcgttgccgctgcaggtccgctggtgattggtcaaggcggtaaagttaccactgcagaagcagatcagtcaactactcctgctgctactttaacgcctgcaactcctgtcggcaaggcttcagcagatatgccgggatatacagaaatcgatctgaagcagattccgggtgatgtatatgcattgatgggcaatggaaaactggtgatctctatcggcaaagatgaattcaacatgaccaatatgacagccaacgcaggcggcgcactgggttatcaaaacggtaaagccgtagcttattgcacactttctgccgatcagccctacgaagcgatagaaaaagcagaaacttatacactgaaactatacgctccgaaccaaacgaccccttcggctgttatcgaatgtaagaaactaccttcacaaacgactccgcaagccggacaaccccgtacgtatgtcggagaaatcgtgaagctattgatgaaaaaataacaagatagcaatcatggaaattaaaagtagatttgatcactttaatatcaatgtaacgaatctggagcgaagcattgctttttatgaaaaagcgcttggcttaaaagaacatagtcggaaggaagcttccgacggttctttcatcctggtctacctgacggacaacgaaaccggcttcctactggaactgacctggctgaaagatcatacctccccctatgaactgggagaaaacgaaagtcatttatgctttcgtgtagccggcgactatgacgccatacggcaataccacaaagaaatgaattgtgtctgttttgagaatacagccatggggctttattttatcaacgacccggatgactactggatagagatacttccacaaaagaagtaaccttataaaaagaagcggggcaggatgatcatcctgccccgcttctttttataaggttgttagctattcatgacataacacatccccaaaatgcttgaaataatgaaaaaacatccgggaataaataaacgaacaaacaatcttgtcaattgcattttttgctcgacaaacattgcatcattatccaaattataccaaaccgtaactttatcacctatatgaaaatctttcgggtaatatgaaaattgtgtgatatcctccacaataatattgggattgatagaccgacagcatttttcaccctctccttctaatgtaaattcaacagacgggcgcataagaagctttccatccttcacataagtatcaacatccactactattccatctatcttcttaatgtatttcgtttcgactctcttgattaaaagacaaaacatcctcatcttaatgatcaaaccaagtccatggccagccagcaaaagtgctagtatacaaacaattgttcccatttattttttatgtcggttagctctctttttccgaatatccgctttcatcttcgcggctccggaaccatgttgtccacgaatataagtcgctttcttcgctttcgtcttcactttctcctcctcctggggcttatctttcttacctttaaagacgattccacccatgattgcatcttctatactcatatatattatattgttagcattcacatttctgatgcaaagataagccttttctacggaattgtttatctttggcggataaaacaatacataatcaccaaaatggcaacaataaccctttccgcagaaaaggacccgatgggagctgcaatctccgattatttcaatcatcacagagctgaccgcttgcgagtattctcttctcaattcgaagaagatgaaatccccgttaaggaattattccgaagtatacagtccatgccagttctcgaacgcactgctctgcaaatggctacgggaagaatattagatgtaggagccggaagcggctgccacgcattggcacttcaagaaatgggaaaagaagtttgcgccattgacatctctccgctttccaacgaagtaatgaaacaacgcggcgtaaaagattcccgcctcatcaatctctttgacgaaacattcaccgaaacattcgatacggttctgatgctgatgaatggttcgggcatcataggaacactaaataatatgcctgccttcttccaacggatgaaacgtatcctacgccctggcggatgtattctgatggattcaagtgatctgcgctatcttttcgaagaagaagacggtagcatgcttatcgatctggcaggcgattattatggagaagtagatttccagatgcaatacaaggatgtaaaaggagatacattcgactggctatatatcgattttcagactcttagcctatacgcctccgaatgtggattcaaagcggaattaatcaaagaaggaaaacattatgactatctggcaaagctgagccttgcctgacagcgtattattttaatcagaaaaagccctattcaggatagtgacactatcacatcagaatagtgtaaccatactaacgatatagtgtcaccatcccagtatgatagtgacactatatttattgtgcccgcatccggttcagagaccggcaataagcacttatttcagcatttcattgatctgctgaaccagtgaagcgaactcttcttcattatacagacgagtcagttttacaatctttccttcccggtctatcagcacattccgtgtgattccggcatcacgcaatgcatattttgcaaaaatatcagctcccggatccagtcccagcgggtaagtcactccggtagactttgcgaaggcaagcactttttcaagcggttcgtcacggtctattccaatcagtgcaaagtctgcattatccttatgcttcagccaaatgtctttttctataaaaggcatttccttacggcatactccgcaccaacttgctgtaaactgcaacatgacaaccttcccacgaagagatgacaaagtcacttgtttgccatccgtcaatgtaatcgtaaaatcaggggccatctcccctattctgacaatatatcctgtactatcagcctgtgccgacgtcgcttcagcagtcactttcactgcgtcggaagcactttcagtagcttctgctcctttcttctggcctgaacaagccagtaaactaacggctaataaagccacaccacatacattcataattttctttttcatcttcttgcaatcattagtgagactgcaaatataaaaaaagtacacgatgtatttgcatttttaaaataaattcgtacctttgcatccgcaaaacagaaaacgcctctttagctcagttggccagagcacgtgatttgtaatctcggggtcgttggttcgaatccgacaagaggctctcctcaaaattcaaatgccgctatatgcggcattttttatatccttttcattcgatgttcacgaaacacaaccatgcttaccccctcaacaggctcaaagcaaacacaactgccaaatcctttcttttcaaccgaaagtcacagccggaaaataatccgaatatgattaacactaccgaagctatcccccaacgataagaaagtatttcgaaagctgaaaaaccgatcagcaataaagtgatgaaaaaaacggagccagcccaaaagtggaagaggaaaccgacgcatatagtatgcctttgatacgattcatgaatatattcgactaaaatccgatatttatgactgcaaagatataaatataaatccaagaagatatcaaacaagaagaataatagatttgcactatatcataattcccctccccattattgttgaaaattttcttttaaatattttatattccaatcatcgttcttctccacatcttcacatcgttttaacttccactttaaccgattcatataaaggacgaatggataagatcattgtaatccaccaaaattctgctgattgataccataacggaaacagtgaattaaataaaaaacaaaatggttacaagcatccgaaataaaggatgagaaagcatcaatatctctataggattaggatttgattcgcatagtgaaaaaaaagtccgaacttttttaagttcggacttttaatatagtaagaggacatataatgtttgaagtccctcctacctattatctcaattattatattactcttgaaatacctttttcagatattcaatattcgttccataattcttcttcacgttcctcacatcatccttgtctcgtgagcgttctacaaccagccagcccctccagcccattttgtcaagcgtcttttttaccttattcatatccagccgctcattgaaaggaagagtcactccatccgtatctgtacagtgaatctggcaaattctattttttccaagaatcttgagttccttacatagatctcttccattttctaatgcattctgaaatttaaaatagatcttgataccgggagaattaatctctttcaatagtttcacttcttctcttgcatccaattgagtttcaatgccaattacaactctttccgaagcagccatatcccctacttccttcagccgttttattaaagctgtccgaagttccggagtttcctgccagcctgcttccactccacccaaagggagaaaagcgaccttggcacccattactttcattgcatccagacaatcccgaactaattctttataattagcacgatctaaaaaagactgtccataaaaaccggacatagcaatagaaggaacctctaaattatagttctgagctgtttcacgaaatagctgctggaaatggggctcacgcaatttgttatcgaacatttctcttttaccgagactacccatatccaactcgactccatctcctttcaactcatgcaccaattggaacgaaccaatcttctgacgtttcaatatcatccagtcacatacggcgatcttgtaacgttgttttttttgtttcgatgcagcaacagccagcattggaaaacattctgctacgattaatatccaaaggatatgttgaaataatttctttctattcatcatcttaattatacgctgatcgtataaaagacggatgaaaggaaactttgtaatcggctacattccaaatatttaatactaaaacggaaaaggggatatttataaaaataagataatgacactatcctaggtaaatggtgtcactataccactgatatagtgtcattatcgcagacatatagtgacactatctttttgaaaggattattcaggtaagatgtaaaaaaaataggctgccgaaccctgaaaagtccgacagccttgtcaacccaaaaacgatacctatgaaacactgtgtgttatttcaaatcaaatatcaagcgtttaccatgaacaagttcatcgtgggtaatgcggtatttattgaacttcttaccatccaataacaccttatttatataaagagtttccgatccggtacgattactctcaattaccagctcattttccttataccatttaggatccaagcggatcgttactttattaaataccggagtagtcaatgcatattccggcaatcccggacagtcgggataaaaacctatcatattgaaaatagcccatgcagacatcgtacctgtgtcatcatttccagggataccgtccggtttggtcgtaaagtacttatccagcagtcgctgtgtctctttctgtgtacgccattcttcacctttaaagtaagagaacagatgagcgtaagcaatatccggttcgttagccggatcatatagtccttcatcaaacaccatttgcagcttattgacaaaaggtttctttccacccatcagtttagccaatccatatacatcatgtggtacatagaaagtataattccaagaattaccttcgtggaaaccgggattcggttcaaagttctctccctgcctcggattgaacggactgtagaaagttccgtccggaagaataggtcggaatgtaccgaactccttactataataatgcttatatcccaaagagcgtttatagaacatttccgcatctttcttctttcctaaagcatccgcaaaacgggaaagggcaaagtctgcgatataatattccagtgcatgagatacggagttatcatattgttcacgaagcggcacgtatccttttgacatatagtcatcattgtccggacgcatcagattttccgccccgggtaatgtagccgacttgtacatagcttcataagccagatctacgtcaaagtcacgcaatcctttcatccatgtatccacaatcactgggatacttggatcaccttccatcgtaagagtctctcttccatacaattcccatttagggaaccaaccatgttcacgatacatatcgagcatggtacgtaccatttccatctgacgttcgggataaaccaaagtcaaaagctgatgtacgttacgatatgtatcccacaaagagaatacagtatatcgggtacctttcgttgtcagaatctgatcgctctccatagccggatattcaccatttacatcctgcagaacgttcggatgaatcaacaaatgataaagtgccgtataaaaaactgttttctgtgcatccgttcctccttctacagtgatacgtgacaagtcatcgttccactgtgcacgggcatcggaaagcacctgttcaaagttttttcccgactgttctttatccagattcaaacgggcattctctatgcttacaaaggaaactcccatctgtacttcgacctgttctccttcttctgtttcaaaagtgaagtaagcgcccacatcgtcacctgctatttcttttccatagcgggtatacaatttatatttgccttggtcgcgatcccattctgcttccacacctgtcatcggacgttgctttttccaatatccggttgtggcgggaactttgttcactctcatcacaaaatagatgggaaatacagcttggggattataacagaaagtacccaatagtttcattccctctatttcgctgtcacttacacgacgaagcatggctccactctcattggtcaggccttcgcccaaattcagaagtatatgactctctcctttaggaaaagtgaaacgggcaatacctgtacgcggagtagcagagacttctgtctttatattatacttcgtcaaataattggaataatagccgggagaagcctgttcatccttatatttgctcccatattccttatagtctacattcagttctccggtagtaggcatcagcaataaagaacccagttcaggacaaccgacaccactcagattcacatgagaatatcctgtaaagaaacaattggtatgttcataaggcgtcgaccaccaacgtgcatctttatcgtatgtattatcggcagaacccatcacattaaaaggtactacggacatcattccattcgggcaaacagctccgggattggtggtgccgaagtttgtcgttccaataaaaggatctacatagtctatcaacagactcttttccttatccatagggggggccttaccctctcccccaaatacggggagaagggtgaaagccagtgtgcaagttaataatatacgtctcatatccttcttagataatgctcgttcgttttgtaaaatcaattatttcctggatatagccgaaagccattcctacaacggtatctgcagctccataataaacagctacacgctcaccatcctgcaatgccgcacatgggaataccacattgggcacatccccttgaagttcataaggtgcagccggacctatcagatattcacgggtacgataaagtaccttttcgggatgatccttatcgagtatcgccgaacccattgcataacggaaaccgttgcaagtagtgataacaccatgatagaaaagcaaccagccttcatcagtaaggaaaggtaccgaacctgcaccaatcttggtacactgccaggcactttcagggaaaggagttactttcatgacacaacggtgttcaccccagtatttcatatccggactgtagctgatataaatatcaccgaacggtgtatgtccattgtcgctggggcgacttaacatagcatatttgccatctatcttttgcgggaaaagtactccattacgattgaaaggcaggaaagcattctcgcattggaagaaatctacaaaatcaaatgtataggcaataccgatagtaggtccatgatagccgttgcaccaagttacccaataacggtcttcaatccacgtaacacgcgggtcatatttatattcggattcaatcatttccgtgttaccggctttgaactgaatcggttcatgactaatatcccaatgaataccatctttactgaatcctgtgaagatgttcatctgtacagctttgttgtcacaacggaatacgccggcgaatccatctttgaaaggtacgacagcactgttgaaaatactattggatgaaggaatatgatagcgtccgatgaccggattttgcgagtaacgccacattacatctgtacatccgacaggacgttcttcccagggaatttgaatcttattcataataattatttatttagtaattggttatctattatcactcaaaaatagcaatttattttttcttttttgaatcatcatacgtaaaaggtataaaataggtcatcaaaaaagcaggaattgttgcgatcagtacatagataaagaaactacggtatcccagtaaatcactaaaatagccgctgatcattcccggaagcataactcccagattcatgattcccgaagcaaatgcataatgtgacatctgatgtttgccaggagcaatctgctgcatcatgaacaaggtcagtccgacaaatccgaaaccatagccgaaatactccattgtgatacatgttccgatcagataaagactggtcggctggactacagcaaggaaagtataagcaaggaaaggaaggttgaacacgcaacaaagcatgaataaagttttcttcaatccatatctggcaacaaatattccacccagcaatgaaccgataacaaaggcggcagaaccaaagacgccattcaatgttccgatttctgtcaatgacagccccagacctccgacctctctggaggcacgcagaaacaaaggagcaaccttcattataaatccttccgccaatcggtagagaataatgaagaagatataatatactatatgttttttagtaaaaaagttcccaatcacatttaccaaatcctgcatgatttctgaggtagacttcttgccggtagcgggaacttgtgtagaaggcaacatctttatatgataaagaccgagcaataccattactgcagcaattacggcaaaaataatcatccatgcagatgaatacgcacccttattggcatctatcgaagctccttctatcgctccgaaatattcggccagcatacctgccaaagcaactaatccaccgttggcaaccaattttgccacattatagaaagctccctgtactccaatatatttagcctgatcctctttattcagttctgccatatatacaccatcgcaagcgatatcatgtgtggctccactgaacgcaatcaccgccatagtggaaatactgatagcaaagaaataatcaaagaataacgaaaaagctactactccaaacaatataccactcaacagttcggttaccagtacaaaaaactttttggtccgatacatttcaagaaaagggctccataagaatttgagtgtccagggcatcatgataagagaagtccaaaacgttatctgagtatcagaaatacccaaatccttaaacatgaatacggaaaccaaattgatggcaataaagggaagtcccattgcaaaataagcggtaggtacccaataaatcgggttgatagtttttccttgagaagcagttttattctgttgcatagttcaatagtatatagatgaaagggtcatttttctgacccatctatatataatacaactaagaagggcaaactactaacgcttgcccctacttttttttattttattgttacttcgtcgataaagaaccacgaaggatgccctacaccataatgccattcgggacattctttcgtaccggtgacctcaactttcacataacgggcatgcactggcatttccgattcagtcttcactccgcggaactccactttccccgaacggttttccggcatatcatgtgctccccaatgtgtataattctctccatcttcagaataggaataaaccaccttcagagggaaaagaatccaggctccgatctgatgcaggaaatccgtatctatactatgtatttctttctctttacccaaatctataacaaaagcaccgtctgttccttcccagccaatccagctttcaacgaaagtagatcctccgaatagtccgtccactaatgccgtttttccgatttctgcatatttaccggtaggaggaataagataagtaaccttcgctcctatcgcaacacttttttctgcacggggcatatatctctcccgatacaactggcaatattccacaggagaattggaacgttcattcaatgtcggtacattaaattctttcacccgttcttcaaaaagtgccaatttcggactgatctcattcatatccgtaccagtctcagtacgggcaatttccaattccgaatactgaatgggcaagcgggcacgctgcacacgcttcaggaatttattatcttcagccaccgctttctctgcatcatcaaacagttgattataacgtcgcatcagttgtggtttcagcattccgtatttatgggaaacaggagaatcataaatccacaatctttgtccgctgcctatcaacgctccctccatcaccttgatatactgataaaggtatggcgcagcctctccatagtatccatgcaggaaatgctgcatcaaagaatcaacattcgcttcggggttccacattaacttagataccagataggcacgtaactcagcgaagtctcctcccctgcttcctgcaatctgtgagaaatgcatagtggcatgattctttttgaacagacggatattatcctgcaagatatgaaaattagggaacggagccagataattatcaaaattaataccataatcccacacgaaaatattattagtgatggcagcccagccttccattgctttcacaaactctttacctgaggcattttccgtcaaagtcacttcacggtcacaatctatatcacaaagcatgatattcacattcggcaatggcttcacatgtttcggaggattcatcgtatacagataggcaagcgtggaaaattccttatcgggaaaacgggcagccagcttattcaaaaaagtaatgatacttcctgagagtgctccttcataatcatctatcgctttgcaggcatcacatgtacaattggtataattaccatcattctgactcacagacataatatgcttatccggatttgccttaaaaatagaatcaatccgctgagccacgatttcaaaaacttccgggttactcagacaccattggcttgctttcccgggatggcgtttgcctttaaaataagaataatattccggatggtcttttccatatacggaagcaggaagcaacttatcaaaagtatgcacccaataaccggcagcaaacacttcgtttggctcttccagcctgttccaccatttatatatggagtctgtacgaatagcataacattgtgtctggcggtaacggaaagccggattatctattttatcgataagcggcagttcgattgtcttcgcagggttaaaagagtattcgttttctccccagtaatccactccaagatattgttcgagtaaagttacaactccgtagactgtcccattcccactgcctgaaatacgtaagattccatctttcgtagataggctgaaaccgtcttctgtcactccagctggggttttgctactgattataatatctcctttttttgcattctgcccttttacaatgggaaatgtacaacctgaaattctctgaaggaacaattgaaataaatttgctgatatttgattaatctggtcattttctgatagaataatcctggatttagtttttccattatcaactaaaacgacttgtgctgttgcaggaatataacaacatgctcccaacaaacaaagcagctgaaaaataatacggcgaatgattctcatagcatttcctttaattagtttttagataatacaatccaaaaatataagatactcaagaaaaaaatcagttctaagttttattaacaaagaaaacttagaactgatcacaacatgatataaacagcaaatagcccaagctcattcagtaataaacttgggccattttttattcagtttcagtataaatacctacagtattaatataaggagaataataaagagctccatggaaagttactcttatatattgcgcttgtttagccacaagaagaagaatgtaacttgtcttatttgcaaatcctgaagctacaccaagatcctcatatttctctccatcattacttatcgctatacttgcactttccgaagaataaaaccattcatagaaatgtaaagcaatagtttttatattctcttgttttcccaaatcgatatcaagtatgctgccatccggaacataatcatacaagtcgctagattgtccattcaaagtaaaactccaacccgaatggtcatttattacagaacctaccggtttgtctacacaagataaaaatccgacaagtgctgttttataaacaatatatataactttattctcgcctatatctgctcctactccatcaacattcgtgattgtcactggaataacatagttagtacccagctgcacagaagccatatcatccgaaaaactcaaggcaacactctcttccggagttgtttttccttgtttaatcattattgtcgattgcttcaaacttgcactagtcagtaaagaataatctgtgccatgcaatgcattatacgttccaactaatgccggattaatagcaagagtaactttggtgtcaccatctgcggcccatgccgattttaagataccgtcaagcttccattcactgcttaaatttgtaaatccttgactatactgatactctaacagatattctttacttgaagtcagtgtgacatgatttggtttgtaagtcgattcaaatgtcaagaatatcttactattactttcactcgctgatactcctgttccattaatagaagttatagcaatcgggagaatataattttccgatccgttcttaaattcttccatattagtataatgcacttttaaagtatctacagagatatattccccttgttttatatacaaagttgcattttccagttctgcattttgtaaagctacatagctcgttccatattcactgttgtatgcatctaccaatgacctgtcaatagctaattggatggtcaaatcttgtggtgcaggtttagtacacctgacaggagacaaaatatgttcggtggcgatttctttcaaaaaagttccgtctcctttatactctaaagtagcatttgtttcacttggtttataaatatagacataattgatatcatacggatctgttgcttcgtcatcgtcacatgctgtgactaatggcaatgacatagcaaaaaatgtacctcagaatattcactcgtgacgatgcgatattctttcttaatctataaatatatatatttgcaaatgttgacagcccataatgggcagttagcgccgtttgtatgcgtgatgtcttacgtgtttaaatttagtattgcttatatacatgtttataatgatgaaaaaagccctggaccgtgatggttcggggcttttcttgtacttgcaataagcaagaaggaaaaagatttcagattacatcggtaactgtgctattatctctttcgaacataccggcaatttgccattctttcccatatccacaaaaaccgttgcacacaacaccgtccattggtcaccatatgtcatcgtactgctatggctatacccaaggcaatgcccgtattcatgaaacatggcctgacggggataattatgcggatgggcatccggaggagtcgcatcaaaataaacaccggtataacaataattagccaagccgtacgtattgcctccacctaatccgccgacaccggcaacacaacccagcacaagcccgccatgattacggattctttgacgcaacgcatccagattgatcggatttcctccattgtctttcaacaaaccttcgtatttgttcatttccatattaaactcttcggaagagaacatgaaagccatattgacagccaacgccactccgtgacggcacaataacggattcatatgacgccaatacgcatgaccattgtcagccgaataagaagaaaaacgtataaaccagcgactgtctatctgttctattttcttcataaacggatcttctgtacgaataacaagcgtcacatcatcattggaaagtccgggctgtgcaggcaccactatcttccgtccactacttgtagtgaatgtccgttccgaatctacaaccggcaaggggaatgacgcttccataaacggataaatctgttcaaaatgtgccagttcgaagaactccatgctaaatttattaaagcggcacataatcttcacatcctgaatacctacaggagaaaagaacttgacaagcaactgatgttcgtctgaaatggaaacctgcaacggagcattcgcataaaaagaacgacggcgactgtcataaaagacctcacgtggctcactggccaaaaacatcgtatccgcgcgaaaccgaaagaagtcctccttacgaacataaagtgaaccatcctgattttccggatgcaaataatcaatactaatatgagatacacggcctgcctcaatcttacaatccgtgaaacggtatttacggacaaactgagttccgtcactgcgatcggactcaatcgtcacaaatccggataatgcttttgtgccgggcaatgagtaaaacgagtatttcccggtaatgtcataagattctatctttctggttccggaatatttcccgtctgcaccaagagtcccatatattccttcggcatcgtcgaaagttatatcgattttacgaatgaatctccacatataatcggacgatacattcaaatcgacatccactctccctacagaacgctccaagaccactgtatgcgacaccgaagcctgatctctgccgatatgcaattctattttcttataaaagtaaaccgcatctaacggcgcattttccgcatgatttatcaaccagtcatcggacagtttttcgggttctttaacagcctcatcttcttcctcgctcgtagtagccaaaaaaacgactgtataatcccccatactcaatccttcaatagtcaattttgagaagttttcttccagcttctgatataagggcttaataatctctccacgttcattggcaatagcataccacatacgagtgatctgctccggtttgcttccgcgtgtctgcaccacggacgcatcatcttgctgcaacccaaacaaaaacgacacttgtccggaatgggaaggaacaatgccggtctcctgttcaaaatcgcccgaacagttggtaagcaataatgcgcccagtaatatcattatgattcttagcatcttcataaacagcctcctctatttctttacacaacgtacggatgcaaatgcttccatctgtaaccgctgtttcttaataacggttgtctcggctccttcgaacggcaaccagtaagcccatgcataaccgcccggaagaccgttacgttcgtttgtccacaacacagctcttttcccgaaagccggattattggatgacgacttatctcccttcgagccagccaaaggaataataaggctgcgaccggtgtcttccgaagtaaacttcacataatgctgtgttcccgtcacaccactggacggagttatcagtgttccttctccgatgtgaagtgtagcggcaattgtttctccatttcctgccttatatctacccggaatctcttggtctgcaggaagcagagactgccattcgttaccagtcggtatccggtatccttcagggcaaggcatatgtgtatcattcacccaaggtgcatcagccgtctggttacctaaattgttggaaggattatacccctgccaaggcacgtacatatataaacgtccaaactggaacagaccacccaccgtgttaatccaacttttatgatacatatcttcgaccgtagccccgtccaacggataaatctgatcttccagatcgcggctacgcgcattaaatgccatccatacatttcctgcgatttccacagtttcaatctgtttgtcactcggagccacacgtatctccacgtaatcatatgttccactcaacaaggcatttttcaaatgcaccaaaaccgtatagcccaggcgaccgctgccttgcgctgcaaccgatacattaaatgacgacacgataccttccgcctcttccgacacggacatattgcctacacttgttccgctaccggcaccttctgtagaagaaatatcgatacgagtgtctgtaacgaacgccagcgtcatgtcatcagcacctgtagcaggcacttccagtatattattctcatagtctaccttcaccccttccggaatcctggatttcgacgcattaagcaaaagacgttggttcgtatcaggctttccgacaatcgtttccccttcttcccacggtttgatctcaaaaacgcctgtcacttcagctcccacattgagcactgccaattcatatactttattgcgttcgacaactggtaattcgacttttaacctgatagggacttcaccataggttccacgcaagatgatattgacaggacgtgtgctttcgaacagacggaataccccctcttgcttgccatcgaatgcagaagagaactccttccgatagctcaccgttttatccgacgcccggacattttcgaggaatggtaaagtctcggcaggagcattctctacgatgacttcctttatctgcgttttgctgtcggctgttgtgttcaaatcaatgcgcgccacaccgcgtttcataattacattgacctccgcattgctgcgtgtcactactccgctctccaattcgactacagccgccatgaaatccggcgcagaattatcatgcaatccttcaccgataatcgtattacgaaattcttcttcacttttagctttctctccggcaggaatctccagtccggtcagaaaataaagtcgagatccgctgaccgcagaaatctccgactgtccgccttgcccgggagtcagctgttcctctttatataaattcccgtcactaaactggaaaaccgatacatctttgagctcttcagaagattcttctcctgctaccgtaattccttttaataccactgaataagtttgttgatggccttttcccccggttggttcatcgttcgagcaggcgcctgaaagtaatgttcctattataatgggaacgatggtttttctgcaagaataattcatgttttttgattaaaataatactgaatattggaaactttataaatgcattttccaaaagcggcggcaaaaatactacttttttcaatacagcaagtcatctgcataaaattttaataaatatgttaaataaaagaaatctttaacgtcagactaactaaatacaaaataaaaagttattttgcaaacgttttttaattttatctcattctaatattatgtacaagatttttcacggcttccacctagtagaagcttatcaggacttaaagaaagctaaacggttagcaaagaatcagacagtggcccgatgtataaagttaaccatagctattaccctctctcttattttatggttccttcccattgatacttttggaatagaagggttgaccgttatagaacaaagacttatttccattttcattttcgccacactcatgtgggtgttcgaagctgttccggcatggaccacttccgttcttattgttgtactattattacttaccgtttccgacagtagtttatggttcttaacccaaaatactcctgcggaggaattaggacagacagtcaaatataagtctatcctgcattgctttgccgatcctatcatcatgctgtttataggtggatttattcttgccatcgcagcaaccaaaagtggactggatgtattgttggcacgagttatgctgagacctttcggaacacaatcacgatatgtgctattgggattcatcctcgttacagctgtcttttccatgtttcttagcaatacggctacggcggccatgatgcttaccttccttactcccgtattaaaagcactcccggcagatggaaaagggaaaatcggattggctatggccattcccgttgctgccaatgtaggtggtatgggaactcctatcggtacaccacctaacgccattgctttaaagtatttgaatgatccggaaggattaaatctgaatatcggttttggagaatggatgagctttatgttgccttacactattattgtactgtttatagcctggtttatcctcttacgactgtttccattcaaacaaaagagcatcgaactgcaaattgaaggtgaagcaaagaaagactggcgctccattgtggtttatatcacctttgctataacggttctattgtggatgttcgacaaatttacaggagtaaactccaatgtagtggcaatgattccggtagctgttttttgtataacaggcgttattaccaaacgtgacctggaagagatcagctggagtgtactctggatggtagccggcggcttcgcattgggcgtagccttgcaagagaccggactggcaaagcatatgatcgaagccatcccattcagcacatggccccctgtactgatgattgtcggttccggactgatttgctatgctatggccaactttatttcacacacagccaccgcagcattactcgtccctattctcgccattgccggaatcagcatgcgtgaaaacctgtcatcgttgggaggtgtagagactttattaattggagtcgccatcggatcatcgctggcaatgatattaccaattagtacaccacctaatgccctggcacatgccacaggaatgattcagcaaaaagatatggaaaaggtaggtatcattatgggaattataggacttatcttgggatatacaatgctgatcatactcggctccaacaagttattataaataatctattaaaaaaagaagatgtcaaaagcaggatgatacatttatcttgcttttgacatcttcttctttttcgaatttagcgtcctataatcctctccaaaagtttataagaaacaacaatggtataaaacgatatctcgtctactctattcctgatccgaattcacaaacttacttggactgacattataatacttcttaaatacctccctgaaatacttcgcatccgaaaacccgacaatttcagcaatctccgttattgtatattctttctgctttaataattgtgctgcacgttgcaaacggatcatccggatgtagtcagccggagcataaccggtcagcgctttcagtttattatagaaacttgttcgactcatatgatgctgattactgagtacatctaccccaaagtccaaatctcccatattcttctctatacattccttgactgaagctatgaatttccagtccaaagtattagtacaattgacaggtaaatgcttttctttattttcgatactattatagacctgacggagcaattcacgatttgccaatatgtttttaatagtcacctttagtatacccacactgaatggcttggttatataggcatctgctccgatttccagtcctccgagtatatttttctcatcccctaacgcagtcagcaatatgactggaatgtgagacatttccacactcgttttgatagctgagcacagttcgtctccactcatctcaggcatcattatatcggatataacaagatctggattaaactcctttataatgacaagcgcatctttgccattggaacaggactggatattataccctgccataagcatatccacaagataattacgcaaatcatcattatcttccactaccagaatacgctgtaaagaggtttttatctgaggtgcctccaagaccggcaagtcagaagttccccccagtacaacagcatccatacgttcattcggcgtttttggagagataaactttgctttatgcaaatgggtatttcccttcgggaaagtaatttgcacgcatgttccctgatgttcaacactttgaatatggatctttcctttatgcaacttaaccagtttatataccagcatcaatccaatcccacttccggtcactttcaaattgactacattactaccccggaaacaatttctgaataatttcttctgttcagatgaaggaataccaattcctgtatcctttacctcaatactccaagtattcccttcctcgcaagcacaaatacacacgctaccattctctggcgtgtacttcaacgcatttgacaaaatattcttcaagatagaccccattttgtcactatcaaaccacacattcaaataatcaaaattactctcataaacaaatctgacacgcttcatctcagcatatttgcggaaagtagcacaaacatcattcatataagaattcaattcatactcagaaacataaagagtagacgaatatacgtcgatccgttcaaagtttatcaagttggttgtcagctgaagcaatgtattcacattctttagggccatattcatatggggtaatgccttctctgccaccatatggttttcaacaacttcttccagcggtgcttttatcaatgtcagcggcgtacgtatatcatgagcagtattaataaaaaaacgtgtcttctcatcagaaatcttcttttgtttatgcaacatgataacacggaatatgataatcataatcaagaccaccagaattgcataccccaccattgcccacatactggcccacaccggaggggtaataatgatctgaatactccttgtttcataagttttatacttctcctcattagatacagtacgaatttgtaacgtataactgccaggaggcagatttctaacaacaatccgattatcttgactcggacgggtccactctttatgataaccgtcgattttccatgaataaagaatattagaaggataatcataatttatggaagccacatcaagcgaaaaagtattttgaccgtaggccaattccagacaatcagtctcgttaatatccttcttcaagggagatccgtcatcaccaggatagacaggatgataagctatcataaaatcccgtaataacaaacgcgaataatatggctcaggtatttctatgtctgtcggaaacttaacagcaccatcattgccaccaaagacaagcgtactgttactgtaagttgtggcagaaccggcattaaaatttacgctcatcagtccctgctcccgtgtccagttacggaaaaaatgatctttaggtgaataaatcgtaataccattttccgtacccatcaggagattttcatcctgacgcggaataatcgtataaatattatcagaaatcagtgcacaattatcagttcggtactgatgaataaacttctttttattgatatcataaacaagaagacctgctccacgagtaccaatatacaggataccatcttctctctggtataatgcacatatataaggagattcaacaggcaagtcaatataccggtaaacaccggattgcttgtcaagctgatagagtcccattcttgtaccaatccacatttgacgggcatttttctccagaatggtggtgatggaacttactcccggatacaaacgaacatttttagtctcaagattaatgcgtttcaaatgataatatccaccggaccatacatcaccgctcgaatcctttttaatgtcataaatatattggtcaggacgtattcctgcaatggccgcaggcgaaagatagcttattttaaaccctttcttcttttctatcttataaattccagacgtaaaaccaccagcccatatcacaccaggagagacttcacacaacgccaagaagatatgattctcatcatccggcaccggatcaaaagaactaaaaaaagaacaccattctcttgtatcggtctgataaaaactaattccattactagttgcaaaccaaaggtcaccgtcactatcttctatcacatcatgcacctgatcattcactaacgaccggttattgccaagagaatgctttatcaaatcatatcttccataacgattgttacgaatggtaataccagtaggataattggcaagccaaatacgctcctcctcatccacatagatatcattgatattgtttccgttcattccattataactgctatagtcagccgttatataaggttcactcttacaagtatttacattcagcttatatactccttttccacccgtagctatcaacaactcatcagcgttcagagcaacaatctgattaacttccacattgtttggtgcataacaaggagtgattttttgggttttaccaatatcatatataagtatcccttctttataactacccacaaataattgctttgacacagtatggtaatacagttcgtgaacaggtgtaacgatgctttttactacttcatcaggaatttgtttcagttctcccttttctatcccgacacaaaacaaaccgcttcccgtaccgataaaaaaatgaccgccatcagcctgctcaatagtagatattgcaccatcgacaggctttggcatatgttgtgttgttccagtacgaatattataccaggtaattgtatctttgtaacatagccaaatatgatcattcttgtccagataaccataatcaagaaatgcttgaaacttatttcggatcaattcagggtgtacataagccaattcaaatttatcatgttgtgaatcatacctgaaaatacgtcctttctgcccgattacccataatacatcttcctgatccatataaagccagttcaaagctatccgtgagtccagcttcatactgtcatccgagaaagtataatgcttgatgtgtttaccgtcataacgatctaccccctcctgagtcaaaaaccacatatatccgcgtcggtctttttgaatatggtagattttctggttgttcaaaccgtcttccaaccctatgtacttataaatctgccccttgctcacagcactactaatgagaagaactataaacactaaaagttttctattttttacaattatcttcattcctttcacaaaacactcaaaaatatatttgcaaaaatatgaaaatattatttaaacagcaactgaataaattaataattatatgttaaaaacagaaacttaaaaaacacaactatctcatctatcggaaataccgcataataccccaaatactccccaataaaaacatcggaaatagataagtgttctttctaaattatattagtcattttttgtacgattttccagcatcagatcataaatatacacgaacaggaatcatcttattattaggacaatttcaatcatatatttattccttcggctatgcatttaaaatcatgattaaattgtaaataatattatgatcaagatagattcaaaaattccagaaggcccggtggctgagaaatggaccaactataaagctcaccagaaattggtgaaccccgctaataaacgccgtttggatatcatcgttgtgggtacgggtctggcaggtgcttctgctgctgcatccctcggtgaaatgggtttcagagtattcaacttctgtattcaggactctccgcgccgtgcacactctatcgctgcacagggtggtatcaatgctgcaaagaattatcagaatgatggtgactccgtttaccgtctgttttacgatacagtaaaaggtggtgactatcgtgcacgtgaagccaacgtttaccgtctggccgaagtatccaacgctatcatcgaccaatgcgtagcccagggtgttccttttgcacgcgaatacggcggtacactggacaaccgttctttcggtggtgcacaggtatcacgtacgttctacgctaaaggccagaccggtcagcagctgttgctgggtgcttactccgcactaagccgtcaggtaaacgtaggtacggtgaagttgttcacccgttatgaaatgcaggacgttgtaatcatcgacggacgtgctcgcggtatcattgccaagaacttaatcaccggcgaactggaacgtttcgctgctcacgccgtagtaatcgctaccggtggttacggtaacgcttacttcctgtctaccaacgctatgggttgtaactgtacagctgctatctcttgctaccgcaagggtgctgtattcgctaaccccgcatacgttcagattcacccgacttgtatcccggtacacggtgacaagcagtccaaactgactctgatgtccgaatctctgcgtaacgacggtcgtatctgggttccgaagaagaaagaagacgctatcaaattgcagaaaggcgaaatcaagggaagcgatattcctgaagaagaccgcgactactacctggaacgccgttatccggcattcggtaacctggttccgcgtgacgttgccagccgtgcagctaaagaacgttgcgacgcaggtttcggtgtgaacaacacaggtctggccgtattcctcgatttctctgaagctatcaaccgcctgggcatcgatgtagtgcttcagcgttatggtaacctcttcgacatgtatgaagaaatcactgacgttaatccgggcgaactggcaaaagaaatcagtggtgtgaaatattataatccgatgatgatttatccggctatccactacacaatgggtggtatctgggtagactacgaactgcagactaccatcaagggtctgttcgctatcggtgaatgtaacttctccgaccacggtgcaaaccgcctcggtgcttccgcattgatgcaaggtctggccgacggttacttcgtattgccttacactatccagaactatctggcagatcagattactgttcctcgtttctctaccgaccttccggaatttgccgaagcagaaaaggcagttcaggctaagatcgacaagttcatgagcatccagggtaaagaatcagttgattctatccacaagaaactgggtcacatcatgtgggaatacgtaggtatgggacgtacggcagaaggcctgaagaaaggtatcgccgaactgaaagcagtccgcaaggaattcgaaaccaatctgtttatccccggttctaaggaaggtatgaacgttgagctcgacaaggctatccgtctgtatgacttcatcactatgggcgagctcgttgcttacgacgcattgaaccgtaacgaaagttgtggtggtcacttccgtgaagaataccagactgaagaaggagaagcaaaacgtgatgacgaaaacttcttctacgtagcttgctgggaatatcagggtgacgatgaaaaggctcctgtattgatcaaagaaccgctggtatacgaagctatcaaggttcagacccgtaactacaagagctaatcggtgaagttaaacatttaaaagaattagacgaaaatggataaaaatatatcatttacactgaaggtatggcgtcaagcaggcccgaaggctaaaggcgcttttgaaacctaccaaatgaaagatatccccggtgatacttccttcctcgaaatgctggatattctgaacgaacagctgatcagcgaaagaaaagaaccggttgtattcgaccacgactgccgcgaaggtatctgcggtatgtgttctctttacatcaacggacatccgcacggtcctgcaacaggtgctactacttgccagatttacatgcgtcgtttcaacgatggtgacaccatcactgttgagccttggcgttcggccggtttccctgtcatcaaggacttgatggtagaccgtactgcttatgacaagatcatgcaggccggtggttacgtaagcgttcgtacaggtgctccgcaggatgccaacgctatcctgatcccgaagcccatcgctgacgaagctatggatgccgcttcttgtatcggttgcggtgcttgtgtagctgcttgtaagaatggttctgccatgttgttcgtttcggcaaaggtcagccagttgaacttgcttccgcaaggtaaaccggaagctctacgccgtgcgaaagctatgttgtccaagatggacgaactcggattcggtaactgtaccaacacccgcgcttgcgaggctgaatgtccgaagaacatctctatcagcaacatcgcccgcctgaaccgcgacttcatcatcgctaaactgaaagactaagcgtgagcttgatttgattaatagcataaatcccccgtcggcgttagctggcgggggatttctttttactgaccaattatttatagatagcttgttcattatccgttttttattcttttctttgtgacataaggccagacaatcaaataaattaaatacgatgaataaattattgctgatatggatagtagtcttactaacctcatgcatcacaaatcaggagaatgccagggatacattatttgtaaatcttacggatgcaactgattcccaaagcctaaagttatctgacttcggaaatactgtacgttatgtacctttggaaaccaacgaagtatgcctgataggaaacaatccccatatagcgctgctggaagacaagattgtgattgctactaaagaccaatgtttcttattccacaaacagaccgggaagtatatatgcagtataggccatatcggtgatgatccaagtggatatagctcgacaaattactggatagatgatgcaggtcttttttacttctttcgcgcaccggaccagttgctaaaatataatcagaaaggagaaatgaccgggaaaattcaaattccacatatacctgccgcacccgactttttcgcgttttccgactctaccattattgcccattgtaatagtagtataggattggaatccagcaactctttgcttttcctcaactcctttggagaaaagctggattcaattcccaatttattaaaatcgccctctatcccttctccggataatatatccagcctttctatcataaaaagaggagcaggtttctttggaaatctgggaagaagaggggtaatgattatcaaagataaggagcaaggagaattactgctgcctctctataatcccagcctatggtcgtccgagaatgaagtacgtttcagagaaaccttcacagacacgatatacacaattaaaaacaggaaactatatccatatatggtttttcatacagatacagatcattcatccgccaatcctttatggtatagtaatccgcaaagtatctacgtagcttatgtattggaaaacacacattctgtattttttcaatacgtaaaaaacaaacaagtctataatggtttgtataataaagaaacacagcaaactaagtttgcaaagtgccagcaattcattgttgacgatctcacttcagagcaggaactgaaagttgacctgtcggcattgtgcagttataaaggagaatatggatttattctggaagctgccagtattcctgatgcttctcaaaaacaatctgacaataaaaatgagaatattccccattggatgagccaattggatgaggatgccaatccggtcatagcaattgtatctgacaaatgatatataattctgtctgttttgcctaatagatatgctttggcaaaacagacagttgaaatagtagcacctatttaaaagtaaacaaaaggcttcaactcatttccttgtttatccaccggataaagagctccttccttttctagccgggcggacatttcccgaatcatctctctgcattgatccggatgtgcggcagacagctcattcctttcttccggatcgtctttcagattgtaaagcaaggctttgggttgtttcggagtctcgggaagataataataaatcagtttccagtcgcccatgcgataggtggtgaagtagctgccgcggtgtgcgtgagggaagtgcatcaggaaagactcgggacgcttcttgtccaccttaccgctcagttgctttttcagatcgaatccgtctatcacgtagttttggggaacttcgcatcctgccacagacagaacagtcggatagatatccatgattgtgcccaactgtgtctgcatacttcctacttcaataggcaagttcttctgtactttgctcttcttctcaggcttggcccaagctgcgatgaaaggaacacgcataccaccttcaaactccgtcccctttttacctctcagcggagcggaagaaccatagccacgttcatctcccaatggagcatcaccaccgttatctcctaaaaagagaatcagcgtattttcggcaattcccagcttttcgagttggtccatgatgtcgcctaatgatttatccatgccttctatcaatgtagcaaaagctcttgcctgctcgttcttatccgggtcggtgtagcgtgacaagaaacgtttgtctgcctggaaaggtgaatgaactgcgtaatgggccatattcagatagaaaggtcgtttttcttctacggctttggtgatctcccgattcgcttctatagtcagcgcttcactcaggaaggtatctgtaccgtgatatttctccaggtcaggaactgctctaatcttctgtcccttgatatgcccgtatccccattcgccataatagctgccgggatgtccaatgccggaacctgcgatatttacatcaaagccgatattcagcggattctctccttcgcttcccatacagccgaaatgtgcttttcctacatgaatggttttatatccggcttgttgcaggactctcggcatggtaggcatatcttttctgagacctttccagttccattggggcggtccgaaaggattccggttgttgctctcagcattaatccagttagtgactccatgcctggtcgcattctgtccggtcatgatggaagctctggaaggggaactcacgctctgtgcgtaaaaagtagagaaacaaataccctgtttagccagtctctccatattcggagtatgataccagtcattcagcggatgacgcaccggctgaccactctcatctgcgataaaaggaaccgacgtatccataagtcccatgtcatctacaaggaagacaataatattcgggcgttcctgagccaccccgcaaacggaagatgccaaaccacccaatacacaaaattccttaaaagctcgttttgttctcattacatagtatttatgatttatatcctagttattgtacgtgtcgcaatagatttaaatttactgaaataaaaagtttaatttccgtatccgccttgtcatggctttatttgaagtgatccgactctataataaagatgtattagactgattttaagggaaacagcagcaatatacaacaaatgcactatgctcacaaagaaaaaaagattatttgacgttctctctgaaaaattatcagatggtctttttgtttgttcttagcatgcgtggagaagcaccgaagaatttcttacagaaattggagaagtgtggcagagattcaaagccatatttatagcatatttcagagatactgttgtttgtattaagcaactcgtccaaaataccttccttacgtcgcgcctgcatccattcgtataccggttcgtggaatacattattgaagatacgccgcagggtactgacagtatagccgccaagttgggcaagttcttccactgtttttactttcttatagttttgaaggatgaagtactggaaagtggaagtgtatttagagagtggatgtaccaagcttgccaaatcatagtctgaataatagtaccccaatacaaatgccagttccttgcgctttaacgacagcaagtcccgacaaactttactttcactcaaataggatttagagccatccaaaaaatatttcaattcagggattatctttaatggtgaatagattaatggtgaagacacctccttcataatatgattgaaacggaagtcacagaatagttccggctgaatgaaacgataataaatacattcgcactcagtcatggcaagcatctcaaattttgaaccgatagcctgaagaataaattcacctgctctcagcatcgtacctgcatattcttgactattaaccaatacctcacctcttatcaaaaaaaggatgaagttttcctcacatttccgggctggttggtgatagcctcttggatgaataatgtgagcaatagcattgtctacggctttcgggcagttctgacaatcccaagtaccttgacagatagatgacatatatttgtgttggtgtttgatttgttcctgttggccaacaaatgtatatgaaatcttttatatgacaatgagaaagggaagaaatttataaaatcactctcgttgcaatatgtcgtaacgagaatgatcttataaattcaaaactacataaactggtataaaagactataacctgagaaatattattctattaatacattaaacgctaggttcggtagtttcaggcttttcagtatcccatttagcagctgtcgcttcgatctttacttcttcaccaccaaccggtaaagtcagcttatacaaaattttagttccaaaagcccatgctgtggtagacttcaaaggaatctcttttgatcctttaaatatatagctatcgcccttctttgtgttatacctaatcgttattttagcatcagtaatatcttgtggtatcaacatcagtgcattaccaggaacaatggcacttgtcccgtcagtaaaatcacctaaagtatatgtatacgtcgcttcagtgccttctggcgtccaatcgccagtgtcagctcctgtataagcaaaggttccttcgcctttaatgccacttattgtaacagcattatcagctgcaaattcgtaggtataatctgtacttcctttaatcacctgaacattaatttgagtcaatgcatgtttaaaatttaacgaaacaactggtgctgttttatccgtttccttagtctgattcaacacggacgaaataactaagtctttttgatcggcagccgtatcccctactttataagtaaatttaggatatcccgcaatagtaccatcaggaccagtatatgtaactccatctgacggagaataagcaaaaaactgtaaattttcatctaatggccagtaatacggacctcctgctactgaccaagtactagcataagttgccttattagctatccatgctgaagacggaagaaccgcagtagtagacatttctgtcgttcctgtattatatgcataaacctggaaaccagcattttgtaaaccttctgtatcaagtgcagttgctctagttactgctgtactaaaattaatttccgccttttgtcccggattctcaaactcttcactctgtgaacaacctgtaattgttgcaactgctgcaatagccaataaaatctttttcataattgtattttttaattcgttaatattgttatatttgtttatgtttaatctcactcaacaggcagaaccacttcatcctcatcgccccaatcaccaacatctccaccaataccaccacctccgccatccggattagtagtcggcttctcaaccttaaccttttcatcaagtggcaactctatttccgtgggaggttcatcaacatttcctcctccactacctccactctcagaattagtaaccacctccgttatatcaatctccgctttctgcacggttttatctactttaataaaagccagtgtcagctttatcttgtcacctgcccggcttatcgcggcctccggcattccaaaagcagtaaaactacccgttacttcacccgaacgcccttgcgcctcaaagtaaataggagcatcgcacatcatcccgcaacatctgcccaaacagtaacaacccgccataccttccacactgcctacaattgaagaaacatattccagtccttccaccttgatcttgaaaaaataggtctttaccactaatttcggtttccaatccagtagaagctcttcttcactgttcgctatatgtaaatcatcgatctgcactacgtataagggatcaggtccccataccattttctccgttcccgctattcccagaccattgcaatagcctgtaaatgcttcaatcgtctcataggcttcctctcctctgatctgcaccgtttcagtgtcgtagttgtaagccactaccgagtaacgccccggcggcacctttacttttccacctcttactgaaaggtatgtatcaatctttctgccttccgcactcttcggataaaaaatcacccgaaccccttccggcaacttatcggtaacaccgttccaatctaactttatatctaccccgcttacgggataatcatccaatagttcgcgacggctacatccggtcagcatcagcagcgaggacagaagcacaagaagtatgtatcttgtatcttgcataacgtccttatctccctctttttatcagccataccagagagactttcgccttggtaggacctataaagttataacgtccactagttgtccacacgatatccccctcgtaaggagtatatttcttatattctgttgtcagatacccgatgccgaagctaaattcgagcgacagatggcgagccagttgcctcgcatacccgtaggtcactcccgcagctccgtaataatcgccccgataaccgtcgcccttccactggaaatcgtaaattccaccttcagcataaagcccaacaaaatgccctgtcaaccggttgcgcttctgacgattgcccaaccagcaacgtccttccactcctcccgaaagaagctgataacagaaattgtgtttactgttgagccaccacgggcatttgtattcagcatttaaagaccaccttttgcctaccggaatctctacttccagatttggcgccaacgccaagtcgtacaacagattattcttcactgcaagcaccgttttactttcaaccggcccttctgcctccgacactaccacctcataagccatactctctttactttctccctccggcttatcaggttgatcgctcggaagcgcctcttcctgctttgaaacaaacaatccggagacagaagataccggttcaaaaatattcttttccatttccggaactttgcggacaaccgtaatctcagcgcgtctcaacttaggtaacacgttgcggacaatatatcggtaagccattccctgattcaacttctgcaacagttcttttcgcttcacgatgttatcccgatgataatctatcaacatcaagacttcttcccggtccggcaagtctgaatccgacgccaccaacttacgaagttcagaccagtcttctccttcagaagtaagtttaatcttttcgacatcaacatacggataacgttgccttaagaactctctcatcgaattgtttcttcggacagataatgcggcattataaaccgaatctccgtcaggcgatacaaaagtgaccacattgagcgcagtgatatatcttgaatttattctttcctcaagcaaagaatctaaaacattaatttcttgattattagttttataacaggaatcaacatctgtttcttcctgatcgaaatatatcaccacccgcctgatagtgtcactcgcaaccgtgaaaaccggaaccactgcatacacactttctgataaagcaagaaatgccatgagaataacgcatgtatagattccgtgtctccaaccttgcccgttatactatctatgcacctaactatggtacaaccgattctttcggcggacagagctacggtacggcatacgatatcacaggttctaacggtggcggtgtacttccttccggtttcaaacgcaaccagatcggtaacgacaatatcaaatgggaaacaacgacacagaccaatgtcggtatcgacttcagcctgttcaagcaatcactgtacggttcactggaatactactacaagaaaacaacagatatcctgactgaaatggcaggagtaggagtgctgggagaaggcggcagccgttggataaattcgggtgcaatgaaaaaccagggttttgaatttaatctgggttatcgtaacaagactgcctttggactgacttacgacctgaacggaaacatatccacttatcggaatgaaattcttgaattgccggaaacggtagctgccaacggcaagtttggtggtaatggtgtgaagagtgtagtcggacatacttacggcgcacaagtcggttacattgctgatggcatttttaagtcgcaggatgaagtagacaaccatgctactcaagaaggcgctgctgtcggccgtatccgttaccgtgatattgaccataacggtgtgattgacgaaagagatcagaactggatttatgatcctactccctctttcagctacggattgaatatttatctggaatataagaacttcgatctgacaatgttctggcaaggcgttcagggagtggatataatcagtgacgtgaagaagaaaagcgatttttggagtgcttccaatgtcggcttcctgaataagggaacccgtttgcttaatgcctggtcacctacgaacccaaactctgatattccggcattgacccgcagtgatacgaacaatgaacagcgtgtctctacttacttcgtagaaaacggttctttcctgaaactgcgcaatatccagttaggatacaccgttcccgctgttatctccaaaaaaatgagaatggaccgcttgcgtttctattgcagtgcacagaacctgctgaccatcaagagcaagaattttaccggagaagatccggagaacccgaacttttcttatccgatccctgtgaatatcacgttcggacttaacatcggattttaacttacttcatcaataaaacgaatgatcatgaaaaagataatatatatagcaacaatcggaattaccttgctgacaaccagttgtgacgattttttggaccgtcaggttcctcagggtattgtgaccggcgatcagatcgcttctcccgaatatgtagataatctggtgatttctgcctacgccatctgggcgacaggtgatgatatcaactcttccttctctctctggaattatgatgtacgttccgacgattgctataaaggcggttcgggaacagaagacggcggtgtgttcaacgcactggaaatatccaaaggtatcaataccaccgactggaatatcaatgatatatggaaaagactgtatcaatgcatcacccgtgccaatacagctctgcaatcactcgaccaaatggatgaaaagacctatccgttgaagaaccagcgcattgccgaaatgagattcctgcgcggacacgctcacttcatgttgaaacagctgttcaagaagatcgttattgtaaacgatgaaaacatggaaccggatgcttacaatgaactgtcgaataccacttataccaatgacgagcaatggcaaaagatagcagacgacttccagtttgcctacgacaacctgccggaagtacaaatagaaaaaggacgccctgcacaggcagccgctgctgcttaccttgcaaaaacttacctgtataaagcttaccgccaggacggagccgataatgcccttaccggaatcaacgaagaagacctgaaacaggtcgtgaaatacaccgatcccctgatcatggctaaaggtggttacggactggaaacggactatagcatgaacttcctgccgcaatatgaaaacggtgcagagtctgtatgggccattcagtattctatcaacgacggtacttacaacggtaacctgaattggggaatgggactgaccactccgcagatactgggctgctgcgacttccacaagccgagccagaatctggtgaatgctttcaaaaccgattcgcagggaaagcctttgttcagtacctacgacaatgagaattacgaagtggctacagacaatgtcgatccccgtctgttccatacggtgggtatgccgggctttccttataagtacaacgaaggttacatcatccagaagaatgatgactggagccgcagcaagggactttatggatattatgtttctctcaaagagaatgtagatcccgattgtgactgtctgaagaaaggttcttattgggccagttctctgaatcacattgtgatccgttatgcagatgtattgctgatgcgtgccgaagcactgattcagttgaacgacggacgtatcaccgatgccatctcattaatcaatgaggtacgcagccgtgctgccggaagcaccatgctgatcttcaattataaagaagactacggagtgaacttcaaagtgactccttacgacctgaaagcttacgctcaggacgaagccatgaaaatgctgaaatgggaacgccgcgtagagttcggtatggaaagctcacgtttctttgaccttgtaagatggggagaagccaaagatgtcatcaatgcttattacgtgacggaagcatcccgttgctctatctacaagaatgcgggctttacggaaaataagaacgaatatcttcctgttccattcgaacagatcagcgcaagtaatggaaattatacacagaatttcggttggtaactaaccatcttaaaacaaagaatacaatgaaatcaatcataaaacaactttatactatcctgttggtgactgtggcatgccttacagtcacaggatgtagtgatgacttcaaatccggccttcgtctggacggagatgtttgggtgaactctatccggctggatgaatacgcaggaactgtcgactatcagaataaggcaatcgtagtaggagtgccctacgattacgatattacccgcatggtggtcacagaaatgaatctttccgaaggagccaaggctagcatcgctatcggtgagacaatcgacttttctcttcccgtatctttgacggtgaagaatggcgatgtacaaatgagctacacgattaccgtgaagagagatgaggcgaagatactgaccttcaaattgaatgatacttatgtaggaaaggtagaccagttatcgaaaaccatttctgtagtcgttccgctgacagtggatatcactcagttgaaaggtacgtttaccgtaacggacggagctaccgtgactccggcatccggaagtattcaggactttacgaaccccgtcacttacacggcaacttaccgttcggcagtaactccttatgtggtaacggttactcagggaaatgtgattccgactgcctttgtcggtacggcttcttccgtcagtcttctgacgagtcccgaagagaaagccgctgcccaatggatgatggataatgtatcgatgtccgaatatatctcattcaaggatgtagtggacggaaaagtggatttaggtaaatataccgctatctggtggcatttccacgcagacaatggtgacaatcctcctttgccggatgacgcgaaagcggcagcggagaagtttaaagtctactatcagaatggtggtaatctgctgctgacccgttacgctactttctatatcgccaatctcggcatcgctaaagacgagcgtgtaccgaacaatagctggggaggaaacgaagactcgcccgaaatcacctctgccccatggagcttcctgattaccggcagtgaatcacatccgttattccaggatttaagatggaaagatggcgacaagtcgacagtctatacctgtgatgccggctatgcgattaccaatagcacagcgcagtggcatatcgggacagactggggaggttatgacgacctgaacgcatggcgtaacctgacaggaggaatcgatttggcacatggaggcgacggggcggtagtcattgccgaatttgaaccgcgttccaatagcggacgtacgctctgtatcggttccggctgctatgattggtacggcaagggagtagacgcttctgccgactactatcactacaacgtagagcaaatgactctcaatgcaatcaactacttgtgtaaataaaaagaataagcaacaatgatgaaaaatatgatcttacctatagcatttaccgcactgatagcttcgatgactgcttgcagtgacgagactgaccccatcttgactcagaaaaactgggacggtacagccacatacttccaatcgagtgatgagcatggcttctcgatgtactataagccacaggtcggctttgtaggtgacccgatgccattctatgatccggttgccaaggactttaaagtgatgtacctgcaagattaccgtccgaaccccgaagctacgtaccatcccattttcggggtggctaccaaagacggtgctacttacgaatctctcggcgaactgatttcctgcggagggcgtgacgaacaggatgctgccatcggcacaggaggaacgatctataaccctgccgacaaactgtattataccttctacaccggtaataagttcaagccttcttccgaccagaatgctcaggtagtgatggtagctacttctcccgatttcaagacatggaccaagaaccgtaccttctacctgaaaggagatacgtatggttatgacaagaatgacttccgtgacccgttcctgttccagaccgaagacggtgtgtatcacatgctgatcgctacccgcaagaacggaaaagggcatatcgccgaatttacctctgccgacctgaaagagtgggaatctgccggaacctttatgaccatgatgtgggatcgtttctacgaatgtccggatgtattcaagatgggggactggtggtatctgatttattcggaacaggcttccttcatgcgtaaagtacaatatttcaaaggcagaacgctggaagatttgaaagcaactaccgccaatgatgccggaatatggccggacaatcgtgaaggaatgctggacagccgcgcattctatgccggaaagaccgcttccgacggaacaaaccgctacatttggggttggtgtcccacacgtgccggaaatgataatggaaatgttggtgatgtagaacccgaatgggcaggcaatctggtagcacaacgtctgattcaacacgaagacggtactttaaccctcggagtacccgatgcaatcgaccgtaaatacacttccgcacaagaagtgaaagtaatggcaaaagatggtaacatgatcgaaagcggtaaaacctatactttgggcgaaggtgcctccgtcatcttcaaccgtctgaaagtacataacaagatttctttcaccgtaaagaccgcttcgaatacggaccgtttcggaatctcttttgtacgtggaacggattccgcttcctggtatagtatccatgtcaatgccgatgaaggcaaagcgaattttgagaaagacggtgacgatgccaaatacttattcgataataaattcaatattccggcagataatgaatatcgtgtgacgatttacagtgaccagtccgtctgcgtgacttatatcaacgaccagttatctttcaccaaccgtatctaccaaatgcagaagaacccgtggtcactctgctgttataaaggtgaaataactgtatcagacgttcaggtaagcacttattgatgaaaactacaccggcaagtaacatcttttacagcgtttgaaacaaaagtgataggcgctaaccttggaagcgcctatctttgcactgtaacaactatcaaaagtataacaaccttaataccatagaacatgaatgtatttttgcctgtcaaacaacttcagacctttctgatttgttttattctcatgactatttctgtttcaacccgagcggcggattctcctttgctgattaagaatctgggagaaggtcattgccttgtacgtgtcaatacttcccagaactacctgcttctgcccgtagaggatgcgtctcccgatgtacgtatcagcatgatcgttaataataaagaggtgaaaaacttcgacgtgcgtctcgccatacataaagtagattactttgttccggtagacctttccgacttttccggcaaaacggtctctttcaagttcaagatgaactccaacgatccgatccgtgtcaatctttcgccggataataccgcttgctgcaaggaaatgaaactctccgacaccttcgatacgaccaaccgtgaaaagtttcgtccgacctatcacttctctcccctttacggatggatgaacgacccgaacggaatggtctataaagacggtgaataccatcttttttaccagtacaacccttatggctccaaatggggaaacatgaactggggacacgctatcagcaaagacctcgtaaactgggaacaccgccccgttgcgatagcaccggatgcgcttggtactatcttcagcggctctgccgtggtagatcataacaatacagccggcttcggagcaggcgcaatcatcgccatctatacacaaaacagcgaccgtcaggtacaaagcatcgcttatagcactgacaacggacgcactttcaccaaatacgaaaacaaccccgtacttgtatccgaagctcgtgatttccgcgacccgaaagttttttggtacgaagcaacaaaacgctggatcatggtgctcgcagtgggacaggaaatgcagattttctcttctcccaatttgaaagactgggcatttgaaagcagcttcggcgaaggatacggtgctcacggcaacgtatgggaatgccccgatttattcgaacttccggtagagggcaccaacgaaaagaaatgggtattgctttgcagcctcggtgacggtcctttcggtgactccgctactcaatactttatcggtagcttcgacggcaagaaatttagttgtgacaatcagccgaatgtcacgaaatggatggactggggaaaagaccattatgctacagttacttggagcgatgcccccgacaaccgccgtatcgccattgcatggatgagcaactggcaatatgcaaatgacgtgccaacttctcaataccgtagtccgaactccatccctcgtgatttgagtctctttgccatcgacggtgggatttatcttcaatccgctccttctcccgaattactgaaactgcgtggtgtttccaaaaagcgctcattcaaggttaacggaacacgtatcgtgaaagatttgattccgaacaatgaaggtgcttacgaaatagaactgtcccttaagaatcagcaggcagaaatcatcggtttccgtctctacaatgacaagggcgaagaagtagacatgcagtacgatatgaaagagaagaaattctcgatggaccgtcgcaagagtggcgaggtaaatttcaacgaaaacttcccgatgctgacttggactgcgattgaagaggataaggatgaaatgaaactccgcctgtttgtagacagatcgagtgtagaggctttcggtgacggtggacgcttcgctatgaccaatcaggtattcccttcggaaccttataatcatatcagcttctacagcaaaggcggtgcctataaagtagattcattcgtggtttacaaactgaagaaataaaaaacgactttcttctccctgcgctctttttaattcatgctaacatacctttatccttgcgttaacatgcctttatgttctccttatgtatgggagatagatagcgtttcacctacgtgatacgatttgttcattactgtgataaggtcttatcacccttgtgatacggtctgttcacagccgtgataagcaaagaaaataggaggctaaaagaaaaaggatcaataggaaaggaaaataattactgtgctaatatacgaaattataatagataaaacaatggaaaatactaaaaacgcttctctctccaaactagtcccggtgatgctttgtttcttcgccatgggattcgttgatctggtgggcattgcctccaattatgtaaaagcagacctgggtctgacagactcacaagcaaacatcttcccttcattggtgtttttttggtttctgattttctccgtaccgacaggtatgctgatgagccgtatcggtcagaagaaaaccgtgttactcagtttgatcgtgacttttgcttctttactgttgcctgtcttcggggacagttacgcactgatgctgatttctttttccctgttaggtattggaaacgcactgatgcagacttcactgaacccgcttctttccaacatcgttcgtggtgaccgtctggcaagcagcctcaccttcggacaatttgtgaaagcgatcgcttctttccttgcaccgtacattgccatgtggggagcaacgcaggcgattccttctttcgatctggggtggcgtgtattattccctatttatatggtaatagccatccttgccattctgctgctcaacgcgacacagattgaagaagagaaggaagaaggcaaaccttccactttcggacagtgcctggcattgctcggcaaaccgtttatcttgctttgttttatcggaatcatgtgtcacgttggtatcgacgtcggtacaaacactactgcacctaagattctgatggaacgtatcggcatgacactggatgatgctgcttttgcaaccagcctctattttatcttccgtacggcaggctgttttctgggatcattcatcctgcgtcagatgtctccgaaatctttcttcggtatcagtgttgttatgatgctggctgctatggtagggttgttcatcttccatgataaagcggtgatttacgcttgtatcgctctgatcggttttggtaactcgaatgtgttctctgttattttctcgcaggcattgctttatctgccgggaaagaaaaacgaagtttccggtctgatgattatgggactcttcggaggaaccgttttcccgttggctatgggagttgcttcggatacttctatggggcagaatggtgcgattgctgtgatgacagtcggtgtactttacttgctgttctataccttccgtatcaaaaaataattttatatttggaaaacaattaaatctgtagatcatgaataatataattgtaggaatgggcgaagcattatgggatgtattgcccgaaggaaagaagataggcggtgctccggctaatttcgcttatcatgtttcacagtttggtttcgacagccgtgtagtaagtgcggtgggcaatgacgaactgggagatgaaatcatggaagtattcaaagaaaagcaactcaaaaatcagattgagcgggtggattatcctaccggtacggtgcaggtgacactggatgacgaaggggtgccttgctacgaaatcaaagaaggagtggcatgggataacattcctttcacggacgaactgaagcggctggctttgaatacgcgcgccgtttgtttcggttcgttggctcaacgcaatgaagtgagccgtgctacaattaaccgattcctcgatacaatgcccgatatagacggacagctgaagatattcgacatcaacctccgtcaggacttctacacgaaagaagtattgcgcgagtctttcaaacgctgcaacattctgaagataaacgatgaagaactggtgacaatcagccgtatgttcggttatccgggcatcgacttacaggataagtgctggattctgttggccaagtacaatctgaaaatgttgattcttacttgcggtatcaatggtagttatgtgtttactccgggagtcgtttcttttcaggaaacgccgaaggttccggtagccgatacggtaggagcgggggattcctttactgccgctttctgtgcttccattctgaatggcaagtctgttcccgaagctcataagctggctgtcgaagtttccgcttatgtttgtacgcagagcggtgcaatgcccgaacttccggttattctgaaagacagattgttgtagaatctctttaaattcaaaaagaaggtgaattctaagtcctctccaaacaatatctataaaatcttacccaagtttacgaacattaacgtatccttgggtaagtttgtatatagacatacctactcttcagaagtgtatagctacacaaattattgttacctttgtaatgtaatgtagttaatggttgcgcttataaagtccttggaaaggatttatgtataaaagaggtagatgtttactctgttcttgtttggattatcagcatcactgatatgaaataacaaaaaaaatatacaatggctaagcggacggacaggcagggaaatagtacagattcccaatccccctctttataatacattgcgtataagatttattaactgtctggtctggggaatctacagagatttaacgaatcaagatgggaagagtcagtctttgtcttgtcataatgttcttcatctgtagtgctcaaaaaattgatgcacaagtacagaatatcagagagaaacaagataccatttcggcgactaaatcattagagcatatcaggcccgagaatatcaagaagggaccattgaataatgctttggatgtattgagtggtcagtctgccggtgtgaacgtcaccactaatgggactgacaggctcgctatgctgaatagtatccgtgtgcgtggtaccacatccattatgggtggcaatgacccgttagtaattattgacggagtgacatctgacatcgctacgctatctaccatatatcccgcagacatcgagagtttcactattttgaagaatgctaccgaaacggcaatgtacggttcccgtggtgcttcaggtgtaattgagattaagaccaagaaaggaacggggcgaggtttcgaaatatcatatgatggcaactacggattcgagtcaatgtataaacatctgcaaatgctcaacggcccggagtatatagctacagcagaggcacttggattagattacaataatggtggctacaacaccaattttcacgatgtaattactcgtacgggcttgatacatcagcatcacttggcttttagcggtggttcggaaaactcaaactatcgagcatcgttcggttttatggatcataatacaattgtcaaagttaacgattaccgaaatttagtggtaaaacttgatgctacacaaaaggctttcgatggtcgcttagttggcgattttggtgtatatggctactcgtcaaagatacacgacattttcgatacacgaatgctgttttactcggcagctgcacagaatcctacatatccagcaggaactgatgttaatggcaactgggtgaagaactcggctgcatcacacatcaaccaccccggagcactcctctatgagaaaaatgactccgaagaacggaatttcaatacacatttggggctgaaatttaatatccttgacaatttgatattgtcggctttcggctcttattcatattcatctacgggaaatgctcaattttgtcctacatgggtgtgggcgcaaggcaatgtttatcgtggagagttcaagggtgaagactactttacaaatgtgtccctctcatataacaatgcttggggagactcacaccttgatgctgttgttggcgcagaatatcttaaacaggtaaggactggtttatgggtgcaggcaaaaggaataacaacaaatgatttctcctataataacatcggagcaacatcatcgcgtcctttcggtggtacgagcagtagctatgaagaccagtcacttgcttcaataatgggtagtgtcacatatagttacaaggatagatattctattgcggcagcactccgtggagatggctcttcaatggtaagcgataacaatactttcggattcttcccatcagtatcactgggttgggatgtaaaaaaagaaggcttcctctctgatactgactttataacaatgttgaaactaagaaccggatatggtcggtcaggaaatcttggaggtataacatcctatacaacacttaataccgtaaaggagaatggtatcgtatccatcaacggtgcacctaccgtaacaatgggaagtatacgcaacacgaatccggaccttaagtgggagactcgttcaacatttaatatcggttttgacttaggtatatgggataatcggttgatgcttacctcggaattatattactcaaagacaacggatatgctctatgagtatgatgttcccgttccgacctttgcgttcgataaactgatggcaaatatcggctcgatgtctaaccagggtgtcgaactaggaatctcggtagttcccattcaacgaaaggatatggagatgaatatcaacttcaatatgtcctaccagaagaataagttactttcgcttagtggagagtataatggtatgcatatgacagcttcagatattactccgattggctcgctttatggtgcaggtcagaacggtggagacaataatgtagtatatcagattgtaggtcagccattgggggtattctatctacctcactgcaaagggcttaaagaaaatgaacttggtggctacagttacgatattgaagatttgaatgatgatggcgagattgattttagcgatggcggagacaggtatatagcaggtcaggcaacccccaaggtaactattggatcaaacatcagtttccgttacaagtcctttgatattgccatgcagataaatggtgctttcggtcataagatattcaatggcacgggcttggcttataccaatatgtctatattccctgactacaatgtattgaagggtgctcctgaaaaaaatattattgatcagaatgtttcagactattggttggaaaaaggtgactatgtaaatattgaacatattaccataggctacaatattccaatgaaatccaaggctgtgaagtcattgcgtctttcggcaggcattagcaaccttgcaacaatcacaggctatagcggtcttactccaatgataaacagttatgtagtaagcaacactttgggcattgacgacaaacgcacctatcctttatatcgtacctattcgttaggtcttagtattcaattctaaccgcttacagttatgaaaagatatataaacatattgatggttgctttggcaacgatgatgacctcttgtcttactgaagaccctagagatcaactttatgaagaagacatttacaacaatgccaacaacatatatattaatgcagtggctgtgctctacaattacattggtggcagtgcagacagtgagggtttacaggggacctgtcgtgggatttatgactataacacacttactacagacgaagccatgatacctattcgtggtggcgactggtacgatggaggtttgtggacgaatatgtatcagcataagtggagtcctaatgatttaccactctacaatacttggaaatacctctacaaggttgttgtgttatcgaacaaatctctgcatatcatcgataagtatagccataacctatctgaggagcagagagtggcctacgaagctgaggtgcgagctctgagagcacttttctactactacattatggatatgtatggcagagtgcccatcgtaacatcctatgaacaaccgcaggatgaagttgtgcagagcgagcgtagcgaggttttccgttttatcgtgaatgagttgcaggaggttgccgagttgttgccaaatgagcgtagtaataagatgggtaactactatggtcgtataacaacacctgtagctaatttccttttggctaagttggctcttaatgccgagatatattgtgatgataattggactgatggcgttccacggaacggtaaagagatatttttcaccgtcgatggtgagaaactcaacgcttggcagacctgtatcaaatattgcaataaacttgccgaggtaggttatcggttggaggacgattatagctataatttctctgtgcataacgagaactccaacgaaaacatattcaccattccgttggataagaacctctatgctgcgcagttctggtatctcttccgatcacgacactacaaccatggcggtgcgttgggtggctcatcggaaaatggtaccagtgccaatatctcaacagtcttagccaacggatacggcacagatgatgtagatgctcgctttgaaaagaacttctatgccggcatcgtagaggttgatggaaagcctgtaatgatggacaatggacagcagttggagtatttcccattggagctaaagttgaatcttacgggaagctcctatgtcaagacagctggtgctcgtatggcaaaatatgaggttgataggacctcacattccgacggtagacaaccggataacgacatcgtgctattccgctatgccgatgctctcctgatgaagtccgaggcaaaggtacgtaatggtgaggatggctcgttggagttgaacgaagtccgaggtcgtgttggtatgccatatcgagaagctacgcttgagaacatattgaaagagcgtttgttggagttagtatgggaaggctggcgacgacaagatatggtgcgttttggagtttatcacaaatcatacgatcagcgagtccaactggctgatgagaaaaatgggtataccacagtttttcctattccacaaaaaagtatagacttgaacccaaaattgaaacaaaatgttggatataaataactttagcctatgagtattcaatttgacattgcaaaacagattatagctgaaacatgccctaatcgcaaacttaagttggagaatattcgcctttttgcagatattattcagcctaagaaatatcaaaaaggtgatataattctaaatgaaggtgatatctgtaattgcctattttatatagaaaagggatttattagacagcactacctaaagcatgataaggatgtgatagaacatttagcatgtgaaaaaaatgttgtctggtgtattgacagctattttaaccgagagccaacacatcttatgatggatgctgtagaaaacagtgttttatgggaaattccgcgtgatataatggaagaatatggaaaataagaaggaagagccaactttgaacaaggtaacgttcgtaaacggtgtgcagattaaaaacaaaagtggaaagcactgatgtgggataattttatctattatggtaagattaatcaaaacagagacagtcataagtgtactgatggggcattttataaagaaattattgtttatcttgctgtttgtcggggtactgattgctccggcaaacgcacaaaacgaaaagaatatgtattcgtacaagaaaattggcaacaagtatattgtcagcattaacaatcatactgaaattgtgaaagccctgaatgctttctgcaaggagaaaggaattctgtcgggttctatcaacgggattggtgctatcggagagctgaccctccgtttcttcaatcccaagacaaaagcatatgatgataagacattccgggagcaaatggaaatatccaaccttacagggaatatatcatctatgaatgagcaggtatatcttcatttgcatataaccgtcggcaggagcgactattccgctttagccggacatctactttccgcaatacagaatggtgcaggggagttcgtggtggaagattatagcgagcggataagtcgcacatataatccagatttaggcctgaatatatacgattttgaaagatagttgcctataaatatcgcttggaatacaggataatacatcattcagcttagatgatatatatcaaaaaaagtttatcaattctgtcacgttaactttgcaacagaaataatttaaagactatcaaatatggataaagacaaggatatgagccgccggagattccttaaaatggcggcattgacaggagctgccatgtgtgtcgggcctaccttgaacaaggtaacggcagcagaacgggtatggatggggaaacaacaagttgcaaacaacatccctgcaggcatggcggcggtgcgcactcggcgaacattgggacacggaaatacggcattcactgtttctgcaatgggatatggctgtatgggcttgaaccataaccgcagccagtacccgagcagggaaaaagaaatcgccctggtgcatgaagctgttgaacgtggggtgacccttttcgatacagccgaaagctacggctaccacatcaatgaaaaattggtcggcgaagccttgaaaggatataccgaccgggtatttgtgtcatcgaagttcggacataagtttgtaaacggtgtgcagattaaaaccgaagaggacagcactccggccaacatccgccgggtttgtgaaaactcgttgcgcaatctcggagttgaaacattgggcatgttctaccagcaccgcatagacccgaacacaccgattgaagcggtggctgaaacatgcagcaaactcatcaaggaaggtaaaatcctgcattggggcatgtgtgaagtaaacgttgataccatccgccgtgcgcacaagatatgtccggttacggcaatccaaagcgaatatcacttgatgcaccgcatggtagagacgaacggagtgttggagctgtgcgaggatttgggcatcggtttcgttccatacagtccgctgaaccgtggttttttgggcggtatgatcaatgaatataccaagtttgatgttaccaacgacaaccggcagaccttgccacgcttccagcccgaagccatacgcgccaactatcgtattgtggaagttcttaacgctttcggccgtacaagaggcattaccccggcacagatagctttggcctggctgatgaacaagaagccttttatcgtgcctattccgggcaccaccaaactctctcatctagaagagaaccttcgtgcctgcgacatccgtttcacggcagaagagatagaagaactggaaacagccgtagctgccattcctgtggtgggtagccgctacgatgccttgcaggagtctaaaatcccaaaataatccgtgtatgaagaaacagatattttacatgacgttcatcgctttactgtcgggctgtaattgttacaaagggaatattctgcaaatagaggaacaaggcagttttgccgtaggtggcaccgtactgaccgattcattgggacacaaataccacggcgaccatgcttatgtattttatcagaaaccggttgatgcacggaaatatccgcttgtttttgcacatggtgtcggccagttttccaaaacatgggagaccactcctgacggacgcgaagggtttcagaatatatttcttcgcaaaggtttctccacctatcttgtcgaccagcctcgccggggaaatgccggacggagtacggaagctgtcacactggaaccggtattcgatgaagaagaatggttcaaccgtttccgtgtggaaatctatcctgattatttcgagggtgtacagttcagtcgcgaccgggaagtcttaaaccagtacttccggcagatgacgccgaccatcggacctttggacttcgatgtctattccgatgcctatgctgctctttttgacaaaatcggtccggccatatttgtcactcattcacaaggcggtccggtgggttggtttactttgctcaaaacgaagaacatcaaagccattgtagcatacgaacccggtggaagtgtacccttcccaaccggtcaagttcccgaagaaggcaaagtcttgacacggtctaaaaaaacagaaggaatagaagtccctatggcagttttcaagagatacatggaaattcccatcatcatttactatggggataacctgcccgaaacagacgaacatccggaactttacgaatggacacgccgtctgcatctcatgcgcaagtgggccgaaatgctcaataagctgggcggtgacgtgacggtcattcatctgcccgatgtcggtctgcatgggaatacgcacttcccgatgtcggatttgaacaatgtggaagtagctgacctgctgtcgaagtggctgtatgagaaacagctggacagatagaaattaacagaggataaccccaaaacctaaataaaaatagttatgaaactgaagtgcttattggcaatgctgctcttaaccttccctttcgtgcagcaacactccggctgttgaagataagatagattcgttgcctcactcagagccggggaaaacattgatagtctatttctcatggagcggacatacgcaaactgtagccaacattatccatgaacttattggatgcgacatggtggagattgaaccggaagaaccctattctgatgaatataatgaagtggttgaccgtttcaaaaatgaaagagacaatcatattcttccagctctgcgtacaaaagtagagaatatggatgattatgatacattgattatcggtagtcctatttggggtggtcttctgtcttctcctgtaaaaagtttcctgtccggttatgatttgtccgggaaaaagatactcccattctgtacacatggaggaagcggaacagcacaaagtgtggataatatccgcaaactatgtccccatgctgaaatattgctgtttatggcagtcaaactgcaaactctcggaatgaagtgaaaaaatggctgtcagaagccggattttctgtcgaattaaattacgcccgtttaatagttttaatactgaaatgaaatatcctttgttatccgcactctttcatcccctttttcagagatttgcagatagaccagtagttgagattagggaatatgagattgtcttcctgacagggtcggtaacgctcgataatctgcaaaggagtatccaacagtttcacttggaacggcacttttgtcttgtaccgtttggacaatatccacttctcaccattcacttctacgatgttgctattggttagttccttgatgtccacgaaagagagggcagtgaagctggcgaaaacaaaaatgtcacgaatatagaacagttggacatccccaactcgtgcgtcatcaacgttttcagttcatcttccgtcaggaactcacgttccgtcacattagggctgatgtggaattgggcaaacgtttttttcggtattagtccgttaaagtgcacacacatgacaacgcctttcagccacatgcatttttcccatatcgtcccgttgtgaagtcccgctttcgttgataggtaggctgcaaaccccttgatgaagtcgggcttaatctccagcatgaacatatccgtccgtctgtaaaaagacttgatgaacgctgccacatggtttcttgccaccacccgtgaacggtggttgccattaccctgtcttttccgacacgcttcttgaatacttcgttctcacgtccggacgctttgagcagtgtctcatactcactgccgataccctgataagcattgctcaccatttcagccgtcacgaacgcttcacggtcgaatatacgcaggtagtgcttgatgatttgagccttgatgttgtcaagggcaaggttgatatcacgtacttccgcactcttgcctttcgccctgttccctttcacgtcccaaagcgttttcgggatactctacttatagctgaactgcgtcacaatcccgttaatcgttacccgtcctatgatgcggacaatatcgtttttctccttgttgccgttcacgtagaacagcactttgaatgtacttcttgccatactcgttttttaagtttaaaattaagtatcaatgagttatgccttgtaaaccaaccgaagccatacggagaaaaattcagcacggagtatcaaaaaccacctttcacggggtaatgatttagcaacctttctacttcataaatttacttttttttgcgttacctcgttttatgcctttgtcctcatttgtcctcacaaacgctttattcatagccgttttaaaaacatttccgcctttctattcctcttttccacagatttttagtaaatttatatccgtctaatttttaaggtcctatgttcagactcaatctaaccaaacattgcataaagtggtactgtttcatccaaatgcaactgatggacacgttcgtacattattttgtgcttgtatcgttatatctattgcagctattatctgtagttcatttgtatccatggcccattacagacaggcgttattcagtatgacttatttttcctccctggtgtttttttgtggagtatgcattgcgcatttgcggcaccggtcaaatatccggatagagacataaaccgtacacgatggaaatatattttttcattctatggtttgtggactccgtgaccattctcccttatatgttaacctatatgtattgggatacgaatattgtccatgtcattatcctcctttacatttttattattgtcaaatagataagatacttacggaagagtgggttatgacctatatacctgcggtatcatggtctgtttttctgctattctgctatactatatagagcttaatgtacccaccctttccaaaaaagaattgcgacgccagcgtgtagccaaacgtaatctacattataatatattaggtggccccagctatactcctgacttcggattactgatcggcggtagtgcattgatgacgtttcggatgaatccgagtgatactacccaacaacgttcggtggtgccgatggccatcgccctgatgttcgaaggaggactgaacctgttcaccaaaccgcagcttttcttcaaaggcgaccgattccgcatcttcggagtctttgcatataagaatacactggaaaatttctacggcatcggatacagcaccaacaaggactatccgcgtggcgaagacaccagcgaataccgttatagcggtgtgcaggtgaatccgtggtttttattccgtctggggaaaagcaacttctttgccggtccgcagatcgacttcaattatgacaagatcactaaacctgccgcaggaatgatagagcaaccatcgtatattgccgccggcggtacggatcacggctactctaacctcagttccggactcggtttcctgctgacgtacgacacccgtgacgttcccgccaatgcttatcggggaacgtatctggactttcgtgggatgatgtacaacaaagccttcggaagcgataataatttctaccgtttggaaatagactaccgccaatacaagaccctaggcaaacgtaaagtattggcttggacagtgcagacaaagaatgtattcggcaatgttccattgactaaatacgcactcagcggcactcctttcgaccttcgtggttattatatgggacagtttcgcgacaagtcatcccacgtgatgatggcagaataccgtcagatgataaatacggacaaaagcaattgggtgaagaagatgctgaatcatgtaggctacgtagcatggggaggatgcggcttcatgggccctactccgggcaaaatcgaaggtgtacttcctaatctgggactcggtttacgcattgaagttcagccccgtatgaacgtccgtcttgacttcggcagagacatggtgaacaagcagaatttattctatttcaacatgacggaggcattctaaataagtatttgctcataattaacaagaaagatgataaaatgcttccataagaacatcattaaataaaattaatccttatatttgcgttgctataacacagcaaaagcagataatagggttaatttatgaaacaaatcagatacctcttcggaggattactatttttgtttgcctccatcggaagcgtaactgcgcaagaggtaagcgattactcaaaactacaaccaagtgattattccagcattacacttccaccgctggatcttcttttcgagaacgcaaaaagcgctccgacctatgaattagctacagtaaaagaacaaattgaacggaagcttctggcaaaagagaagcgtgccttcttaggctttttcagtttacggggcagctaccagtatggtatgttcggtaacgagtctacttatacagatgtagcaattgcaccttacctgacctatgcaacacaggcacagaacggatatacagtaggtgcaggagtcaacattcctttggacggtctctttgacttgacagcgcgggtaaaacgccaaaaactgaatgtacgtaccgcccaacttgaaagagaagttaagtttgaggaaatgaaaaaggaaattatccttctatacgcaactgcgacctcccaattaaacattcttaaacttaatgccgaagccctcatgcttgctaatgtacaatatagtatagctgaaaaggatttctcgaatggagctattgattcgggaactttatcatctgaaaaatctcgccaatctgacgcacaagagaaattcgaaaacagcaaattcgagctaagcaagagtttaatgatacttgagttagtcacccacactcccattttaagaaacaaataaacatacatttatggaatacatcctttatatcagcagattcctatatcgtatccgttggtggttacttattggaacagccattataacatttgctgtttactattttgggaaacgcatgataggcaaaacatataacgtagaggcaaccctctacactggtgctgcttccggctacaatctagaaggtggaaataacaaagtggattgggcgacaactcagaacgctatggataacctaatgaacattatcaaggctgaaagtacactcaaacgggtatctatccgattatatgcccgaagtctgatcaaaggtaatccaaaagaagacaatgaattcatcaaagccagcaattacaacagaatatatgaacacctaaagaatagtccgaacgggaaagaaatactgtcattaatagataaaaacagcgaagataaaacggtagccaactttttcaattacttgagaccgacccaagcaaactatctctatggagtattctattataatttgccctattactcttataatgatctcagagcaatcagagtagcgcgtaaaggtgccagcgatctgattgaaataagttatacggcaagtgatccgggtatcgcttataataccattgacatcctgaccaaagaatttgtaaacgaatacagtgcaatccgttatggtgaaacagataaagttatcgaatattttaaaagcgaacttcaacgcatcggaaaggaacttcgacttaaagaagactcactaacgcaatataacgtagaaaaacgtgttattaattattacgatgagaccaaagaaatcgctgccatcaacaaagagtttgagttacgtgaacaaaacgtactgattgcatacaatagcgccaaagcaatgttaaacgaactggaaaagcaaatgggcagcaatgccaaacatgtaatcaacaatcttcagttcttggataaactaaatgaagccgcttcgcttacaggaaaaatctcagaaatggaaacaatttcaagtgatcatcagaatcaagaagcctcattacaggaatataagaatcgcttaaatcaaacgcgcaaggagctttccgagctttcaaataaatatgtagagaacaaatataccaaagaaggaatagctaaagagaacatcatagaacagtggcttgaagtaaccatgcaatacgaaaaagccaaatcagacttacaaattatacagcaaagccgtatagacctcaacgagaaatacagacagtttgcaccagtaggttccactatcaaacgtcaagagcgtaacataacttttatagagcaaaattacttgtctgtattgaaaagctacaatgatgccctcatgcgtagaaaaaatttggaaatgacctccgctgcattaaaagtgttgaatgctccggcatatccgatcagtgccatgcccactcctttgaaaaaaatggtaatggcagcgtgtgccggtaccttcttatttattttgggattcttcttaattcttgaattattagaccgtactctacgcgattctattcgtacacgtcgtttgattggacttccgatgttaggcgcctttcccaaagactctattttagagtatcacaatcatgttgaagaatcaaaaagtatagctacaaaacagttaagcaatagtatccttcgtttctgtcagcaaaagaaagaaggattgccctacattatcaattttattagcacagaaggcggggaaggcaaaagttatgtgatcgaagccctaaaaaaatattggaacagtatcggacttaaaacaaaagtaataacatggaagtcagacttcagaattgattcacgagaatacaacctggccaaaagcattaccgatctatacacatcagaggaagaagatattctcatcgttgaatatcccaatctgcgggaagctagcatatcgctggaattactacaagaagctaatctaaatatactcgtagcccgtgctgaccgtggttggaaagagaccgataagctcttgtcagaaaagctaagtcaacaagtaggtaaaactccactttatgtttacttgacacacgcatcccgcaatgtggttgaagactacactggtatgcttccaccatatacactttggaggaaaatagtataccgactgtcacaattagcattgacagaaagtatatttacgttcacaaaaagaaagaagcagccggcaacatcaggagatgaagatgacgaatgataaaggaaaatacagtcaatacttaacagtagccggtaactattttgccaataaaggatgggtacatttactattggcaggaggattgtatatattatacaaaatgttctttcgtacttcccttcctttctttctgacgattagttcattacctttaatgacagttattttcttattaattatcaaatattcaaagcaaagtttctatacacttttcattctccaattcctgctggcagcagcttatgcagtgacagacataccattgggagtagcaacattaatgtgtacattgtttgccgttgttttgctctttgcgtacggaatgcatgaaaaaattgactggtcggaaagtcgtaatggtatgcttatgctttttctgatatggggagtttattgcatattagagatagctaatccgaacaatgttcaggcagcatggaatatctccatcacccattatctcatatatcctattgtatgtgctgtcatcgtaccgttagcaatccgtaacatcaaggggattcagtggcttctaattatatggtctcttttcatcctcttggcagcagccaaaggatattggcaaaaaaactgtggttttaatgaacgtgagcagtattttttatacgttttgggaggagcaagaactcatattatttggtccggtattcgttatttctcattcttcagtgatgcagcgaacttcggcgtacacatggctatgggtgtttcactttttggaatttcacttttttatataaaaggtgtatggctgaaaatctattttataattgtcattattgccgccatttacggaatgggaatttctggaacacgggctgcgatagctctgcctatcggtgctttagggagtttcattattctttcacgcaatcgcaaagcatgtattacaggtatttcagttcttgccttgttattcttgttttttgtatgtaccaatataggagatgacaatcaatatatccgcaagatgcgttctgcatttcgtcctagccaagacgcttcctatcaattacgtgtagacaatcgaaagaaaatgagagaattgatgattcacaagccttttggatatgggatagggttatccaaaggcgaccgtttctatcccaaagaacgtatgctctatccaccggattcctggttagtctcagtatgggtagaaaccggaatcatcggtctagttctctacctggctgttcacggagtcctttttgcatggtgcggatggatactgatgttcaagatcatgaacaaacgcctgcgaggcttacttactgcctggctctgtaccgctgccggattctatctggcagcctatgccaacgacgtgatgcaatatcccaactccatccccatatacacagcctttgccctctgcttcgcaggaccgtacattgacaagcggatgcagcaaagtaaagaaacagaactgaaaaacgaacaatagattatgatgaacgaacctcaagtctcctttatcacagtttgctacaacggctttaaagacacttgcgaattaatagaatcgctgcaaacacatgtacattccgtgagctatgaaatcatcgtcgtagacaatgcttcgcgcgaagacgaagcgactaaaatcaaggagctatattccgatatagtcaccctgcggagcgagtctaacctaggcttctctggcggaaataatctggggatcagagtagccaaaggagcctatatctttctgataaacaatgacacttatgttgaatcagacggattccactacctgacagagcgactggaaagtcagaaaaacatcggagccgtctctccgaagatacgctttgcctttcctccgcaaaacatacagtttgccggattcacctccctgtcggcaatcactatacgcaacgaaatgacaggtttcggctgtccggacgacggcacgttcgacaccccgcacacgaccccctacctgcatggggcggcactcatggtaaaacgtgaagtcattgagaaagtaggagaaatgccggaaatattcttcctgtattatgaagaaatggactggtgtacacagatgacaaatgccggttacgaactatggtatgagcctcgttgcaccgtcttccacaaagaaagccagagcaccggacagttcagcaagctacgtaccttctacatgacgcgcaaccgtttgctctacacccgccgcaaccggaaaggtgctcaacggctgctctccattctttatcaatctaccatagctgccggaaaaaatagccttcagtttgccgtgaaaggtcgtttcgatttatttgccgcagtatggaaaggcgttgtcagaagcttttctgtcacctctcctatccgataacccttaaaaatgaaagaccatgtacacctttattgactggattctctttattcttctggcactttgtgtcggttatctgctgttctacgccattgcctccaaattctatcgtccgcgaaaactttccgaagcacgtatcctgcgtcgttttcttgtactcttccctgcatacaaggaagacagggtgatcgtctccactatccgtaatttcctcgaacaggaataccccaaagaaatgtacgacgttcttgtcatctccgatcagatgcagccggacacgaatgctgccctacaaacactccccatctgtttgcaagtagccgactataccaatagttccaaagccaaagcccttacgctggcaatgaacgtcactgccaacgaatcttatgacgtagtagtgatcatggatgccgacaatgtaacgactcccaatttcctcgcagaaatcaaccgtgcttttgagtccggcctgcatgccgtacaagcccaccgcacaggaaaaaacatgaatacagacatcgctgttctggatgcgatcagcgaagaaataaacaacggattcttccgtagcgggcacaacgcgataggattgtcagccggattagccggttccggaatggcattcgacgttcattggttccgccgaaatgtaggacatctgcaaacatcgggcgaagacaaggagctggaagccctgttgctaaaacaacgcattcatatcgaatatctggaacaactgcctgtatacgatgaaaaaacacagaaaaaagaaggtatcaaaaatcagcgtaaacgatggattgcagcacaatacggtgcattgcgggcttccttgcccgatttcccgaaagcactgattcagggaaatatcgactactgcgacaagattcttcaatggatgctgcctccccgtctgatacaactggcgggagttttcggtttcactttactctttaccgcaatcggcttactaatgagtctgcaaagcggaggatatgaatggtatacagccatcaaatggtggatactgtcagccgctcaagttgccgccatgatcatacctgtgccgggaaagttgctaaaccggaaattaggaaaagcaatcctgcagattccgacactggcactggcaatgatagccaatatgttccgactgaaaggaacgaacaaaaagtttattcataccgagcacggagaagaataaagcctcaccgtgaaagaaaagaaaaggcacagatgacacgaattaacacggatttggctgcgcagcctctcaaatccgtgttggcgtccgtatcatccgtgcctaaaatttccctatgaaaaccgtgcctgaatcatattcattagcaagtttcgtcaagcccactcctcctccgcatcaaagcacggacaagccttcacccattcctccggctcgatctccccgttcccgttcagatcagggctcaggtcacgatgtccgcacacccggcaaccgggataatcacgtaacaacgtaagcacaagcacatgcatcgagtgtatctgccattcggtacgggtatcggcaggccgcccgtgacagtcaagtccgccctcatagcaaataccgatacttgtctgattaaagcctttcgcatgagctcctatccgttcaatggggcgggtagtcttgatgtcgccatttttccggatataaaagtgatagccgatcccgttaaatccccgccggcggtggcacacttcaaggtctgtttccgtgaaatccctgtccgccctagaggcggaacagtggatcacaatcaggtcaatcttcctcatcgacctgccctttcgttcgttttccttttctcttcctgcggaagaaaaacaggatctccaatgcaatctccaaaatcttgtcaatcataacttttcatttttacaggttattcatttacaggtatcacacattaatgatgctgatgtacttaccggattaaacggtaggatcgggagcttcctcctcccctccatcgccaccggaaccggaaccgccaccggaaccgccgccactaccggagcctccgccatcaccgcttcctcccgaagccggcgcattcttggagatgagttcgaagaccatgttattgtccccgccacgtgtggtagccgtgctgtcgttggcaagccgcagagaattatcgaccttgaaacgaaggttgacacgagtaatattcctcaccgtacagtccttttcctgttccacaccgggacaagtaagcgtggtatagaaaatccccaagccgtcaaccttcaccttattccctgctacgagcaccttcttcatcgagcggacaaaggattgcatcacatgctccacatcttccaccgaaagcgaaccgatcgactcgatctcacgcgccagcgactcgatagaataaagtttcgattcccccggcttgggtttgagcacatacaccatcggcgatttgtcatcaccaatcttttttttgcgctgatagcgcaccacagacactgttgccatactgaatttgtattaaagaaaagaaggacattctccctttctgttggtgaaacaaagatacggcagtgcaccggcaatttcccggattacgacggactgtgccggactatgacgggataaaacggattaagacggattaagacagcataaagcagaataaagtgaattagaaacagattgaaagcatactaaaaagcgaatacaaagtaaccataaagcagataaaagctgaaaaaactcccaaccaaccccgaatacccccccaaaaaaagacaagcagacaacgtgaataacaactaaataatacaagcataaaagcaacactttcatgagcaacaaatttgctaaatccagtaaaaaacagtaactttagacccattacaacaccctacaattaaatcaaaaatgaaagcaaatacagataccctgcaaaaacaggaagaagaaaaatccttccaataccgcagctacggaaaaggagaactcgccatgctatatatccccaacgtccagcaacaaagcgcagtagaccgcttcaacgaatggatcgaagccgcacccggactaaaagaacgcctgctatccaccggcatgaatccccgaagcagacactacacacccgcacaagtacggctgatcgtagaagtgctgcaggagccttgaagataagtattaagtattggtgccaatcagcagttaaaacaaaataagaatagttccggacaagataccaaattaacgtataaagctgtccgaaaagtagataaatactatcaatctatcattcagcacacggagaagaatctcttctttgactaatataaagagctgattcttcggcagacttagggtgacagagcaaaacgatagcagacgttctcttttcggacagccccattcaatatcattttccggctcactcggatgagcgcgttgcttttcagccgtgtctcttaatgaaatttctgatcttcttcgataagttcctggctaaatttctccggtgccaaaggggtaaagagttctataagattttcttcgggatcgcgcaggtacagggtacgcatcccccaatcgggcatatccgtaggctcactgataaatgtcacgccttttgctttcagtgcgacaaaggtttcgtccacgttatccacactgaatgagatcattaatttttcacgcatcccaacaggctgctgcttatctgcattacctgccgaaggcgccatccagtcggatacaaaaagggcgagaccttctattccgtcggctactttaaaactggcgtatccgctattctcatctccccaggctggctctaatccgagttgttcggtatagaatttgaagcatccggcgaagtcctttactaataatcttacgttactaaatctcattgtttacagattaatggtttattatttgtttcttagaatcgaaatgcaaatataatcattctatcggatgacgtttcatgaatccgtatttacctcaaaactgtgcgaaaataaagtaaaccggtatcaaaatgaatcaccattcaaccagtgatccgcaccgttactcatcccccgtgacctgttacccaccaccctcaccaactacgattattacctattacttattacctaatacatattattgatgtgatcgtttgtttttattcgaatttatctctacttttgcatcataaatgaagatgatatgaatgaagtaaagaaacggttaccattgcaatgtccatcctgtgatgctccattgaaagtaggacggttgttttgtgaagaatgcaatacggaagtttgtggcaattttgaattgcctttactggcgcgcctgtcggagaaagagcagcaatttgttcttgattttgtaaagtcaagcggcagtttgaaagatatggcgaagaacataggagtcagctaccctacagttcgaaatatgttggacgatataatagataaactaactaaaatggatatgtgatgaaaaacaaagtaaaattaatagtgaatccgtttattcggattgcaggtggtcaagcgttgatatggggctttctgggcttaatagtatctaccttattgtgttggatatcgggttatcattatcatggtttgcttcattttggaccggcccccaatccggcttggtggtgttatctggcggaacatctgattgtgtggctgattcctgcactgctcttttatctgggaggtctttttctgtctcattcccgcattcgtgtgatagatgtactgggtactgttttgtttgctcagctgccgttgcttggaatgaatctgatcagcctgttgccggccatgcggatgatgtcacaaatgaacatgaatatgtctcccgaagaaatgctggcacagccttattttatcctggcaatgattcttacactgttgggattgccgtttctgatacttactttgatttggatgtttaatgccttgaaagtgtcttgtaacttgaaacaatggaagttatggacagtcgcacttataggaattattggtggtgatgtcttgtgccggttcctgataggatggttgtattaacggcttaaatatagtgacactatcccgtcacgatagtgtcactatgtctctgtgatagtgtcactataacgagcggatagtgacactattttcaatcatggtaattactacaccataattaattttactcattgaaccagtctatcttcttggagaaatacattaccattgccaaaatgataaatagtcccaaactgcctgctaataatgcaaaggtttccagttgaatcaaaacgaagatataaaggtagagtacacttaatagtccggacatgatcaatgacggtttcttctttttggtgattcccaacatatatccgccaactaatataatagtcagtgccgcagataacaaataagcaggattaaagccgatatgttcggagaaggagagcagcagactatagaacaggcagagtgctaaacctaccagcaaatactgtaacgcatgaatacgggttttattcatgatttcagtgaagaaaatgacaccgaacgtcagcagaataatcagaatagcatatttggctgaacgcatggactgctgatactgctctaccggtattttgaagttgacgccgaaactggagttctcaatatccttgatattggtattgttgtaattcatcaggacctgcgaatagttgcggttcagattcagtacctgccattgtgccgagaattctttttctgtaatctcgcggttgttgggcaagtagtttcctgtaaaacttggagtattccagttggctttcaaatcaacacgggtcgttttacccaatgggataaagttgatggactgcgaacctttcagcttgattttaatctcataaggcagtttcttgttcttcttcagatcggataagtcggtaatggcgtgtactcccgtagcgcctatccctctgttatccattcccggttcaaagacgtaaactgaatctcccagcgtgatactgatctgctcactgatgccccgcatatctgtcaggttcaggcagatggcagctctgtcaaattgcagttgttccatatccaccctgctttttatcagctcttcgggactgaataaacctttcaaagtcagttccgactgatacacgttcacttcataaatacttcttttgagtatttcggttttcaattgtccattgaccagaagttcgtccggaaacaagaaaagggccttgattgataccttcttttccccgttgttctctgtcgttaccggatactggatattcagataggggccggtaatggtttgggcaaggctccatttttcgcttacttcattaattgcttcttcctgcgtgcgtccccgctcggaaataagatcttcgatcatgaacatcggtatcatcagaagaatgattaatcctccgataatgatgaccttgattgttttagagaagcggcggaggcatcccagcggttgttgttcctgcacttgctcagttgatttttcattgaaaccgtccataagataatagtgtttagtgaattattatgttgactttagaaaattctccagggcttcaatatgagatttgaaggcttctctgccttgctttgtggcccggaaaacagttcgcggttttcgtcctacaaagcctttgctgcattcgatgtagccgagttcttccagcgcacgggtgtggctggccagattgccgtctgtcagtgagagttgttctttcagaaaattgaaatcagcttcctcattgaccatcagaacagccataattcctagccggaccttactctcgaatgccttatttatattttgaaatgcttctatcatttatgactgctttctttcgtaatgtaaatagaacagtattccatagaggatatgaaatccaccgaaacctatcgtccagaacagtaaggcgtggccttcccaaaaactatctatgactcccagacagataaaagcgtatcccaaccaagctatattggcataggtaaatttagaaacattgaccaaagtcagtccatagaataaaagcatgaccgaggataaaatgtcataatatccatgcagcagcagagaaatacataaagcgcctccggtcagcatcggaagtgaaaaattccataatgcccgataggtcagcttgctgaaaaacttttgtcgcagctttttggacttgttgtaagacagtatgccggcagtgacggtggcagctgccaatacaaggatggccactataatcatcagcttcaaggctgtgattaatgttgtgtccggggtaacaaggcaagtggcgatgtatgtacccgctagtgcgtaaactccggccatgatagccgctaatccactgatcgagataaacttggaggacttttccatcaactcttttatctcatttactgattctaatgctttatctttattcatataaaaaagtactttgtgatgcaaagtaaaataaaagatttcagatgaacaaagattctgctcatttattttgaaaataagagattagtgtgggtgaatggaacaatttatagagtcgttttacatgaaattagtcaaacgtttgactaattcggtagaaatacatacctttgcgcccggaaaaggtaaaaagtacttttatgataagagaaggagcagagtttagagaactcatgctacaggttttccgtacccgcatggcttttcgtaggtcgatgcagcggacactgagaaagaacaacgcaggtatcacattcgaaatgcttcaggtactgagctgtttatggcatgaacaaggcattagccagcaaatattggctgaacgtatcgcaaaagacaaagcatgtctgaccaatctgatgaacaatctggagaagaaagggtatgtccaccggaaggaagatccggcagaccgccgcaacaaacaggtttatctgactccggaaggagaggagtttaaggaacagattcgtcccatactggatcaggtttatgtatacgcagaacaggtgattggcatagaaagcattgaactcatgttatcggaattaaagggagtatacgatgttcttgaaaacgtatagggtatatctgatggggccgctctgcctgatgttcgccggtcagccggcaaaggcgcagacggattctttatttctttccgtagaccagcttttcgaacggggggtgcagcatagtttgcagcttcaggcggatgcgctcaaagaagccatggcgcaagaacggacacggacggcacgcacatcatcactgcccgatctgcaagtgggattgaaaggaggttttgtgggacagccggtcgtttgggaacggggattgtccggcccgacatatccggatattccggactggtcacagaattacgccatcgacttttcccaaccactgtatcaaggtggcaagattcggaggactatccataaggcagagatggaaaaacaagttgccgagttgcagacattaacagaccaggcggaaatcaaacttggtttgctgaaccaatacatgaatctgttcagccttttcaagcagcatgagatattgatgcggaacattgaggaatccgaattacgcctgcgggatattcgccggatgaaaaaggagggggtgataacgaataatgatgtattgcgcagcgagatgcagttgacgaacgaccgtttgtctttgcaggaaacggaaaatagcatcgtactcgtgtcgcagcagctggatattttattgggacaggatgagaacctgttactgaaaccggatacgaccctactgcatcaggcagttgctctggaagcgtatgacgactatatcacccttgcttacacaaatgatccggcaatgaaattgctcagaaaacaaacggaacttgcccggaacgagatccggttggctcagtcgttgtctcttcccagcatatcgctgtatgcctcaaatacactggcacgccctgtttcgcgtacattgacggatatgtacaacaataactggaatgtaggactgtcggtttcttatcctttatcctcaatctacaaaaacagtcataaaataaaggaaagcaaactgatggtgtctttgcgtaagaatgatgaagagcagaagatgcagagaatccgtatggatgtgcgcactgcttttctgcggcatcaggaagctttgcaacgggtagaagccttacagttgtctgtccggcaggcgcaggagaactatcgtattatgcagaaccgttatctgaatcagttggctattctgactgacttgctggatgccaactctgtccgtttgaatgtagagttgcagctggtcactgcccgcactcgtgtgatttatacttattatcaacttcagaaggcttgtggtcgtctataatatattagggttatggcaacattaaaggaaaaaaaacggaaacttaaaaaaatgagagctcgcaacatcatattaaatatggtgtgtgtatgtttggctgtctccgggctctggtggactattacttatttttggcgttacattaactacgaagtgaccaatgatgcttttgtagaccaatacgttgctccgttaaatatacgtgcttcgggatatatcaaggatatccgtttcaaggaacatcaatatgtgcgtcagggagataccttgttagtgctcgataaccgtgaatatcaaattaaagtgaaggaagccgaagcagctctgctggatgcgcacggtttgcaggatgttcttcactcaggtatcgaaacttcccatactaatatagccgtgcaggatgccaatatagccgaagcgaaggcgaagctctggcaattggaacaggactatcatcgctttgaacgtttgctgaaagaagaatcggtgccggaacaacagtacgagcagaccaaagccgcgtatgaagcagctgaggcacgctatcaggcattagtcgcacaaaaacaggctgctttgtcgcaatatgcggaaacgagtaaaaagacaaccggagttcaagccggtatcttgcgtaaagaagcggatttggatttggctaaattgaacttgtcttatacggtactcactgctccatacgatggatatatgggcaggcgcaccttagaacccggacagtatgtccagacggggcaaaccatctcttatctggtacgcaacaaggataaatggattactgctaattataaggaaacacagattgccaatatctatattggtcagcaggtacgtgttaaagtagatgcgttgcccgggaagatttttaacggggaagtcactgctatctcggaggcaaccgggtcgaaatattctctggttcccacagacaattccgcgggaaactttgtaaaagtacaacagcgtatcccggtacggatagaactggagaatatctcttcagaagaaatggcacaattaagagcgggtatgatggttgaaacagaagctttgcgcaaatgataacaatgaaagagttgggagtacccgttcgttcctgggtgcccgattggttggggttctgttgcattttcattgttattcttccggttaccatgctgaatggttcgtataccggaagcatgctcgaagtatcgaatacgcttggaaccaattcggaagatataacgatgggatattatgcggcttcggcaggcatggccattgcttatcctattattcctaaagtgctggcagccgtttcggtcaagtttctcttgctgatagacttgctcctgcagttctttttgagttggatttgcgcccgttcgcagaatgccgatattctgattgcctgcagttttgctatcggctttctgaaaggttttctgatgttatggtttattcgttatgcacagaagattttcagtgcgaagaatatccgcagcgagttctattcttatttttatccattagtgtacgggggcggacaggcttccatgttggtcactgcgcaattggcatatcactataactggaagtatatgtattacttcatgatgcttttgattctggtttctgttctgtttgttatcatctgtttccggcataaccgcccgattaaatcggtgccgttatccgatttgcatattcgggagatgtttatcatttcggtagggctgctgatgctgatttacgtcatcaattatgggaaagttctggattggatggcttctgccaaactttgtgcttatattgtaatttctcctatactgatcgcattatttatctggattcagcaccattcgaagaatccctatgtaagtcttgcccctctgtttcagcctaaagcaatcatcggatatttctatatgatgcttgttatgtttttcagtacatccaccacattattgaccaattacctgagcatcatcctgaaagtagacagcacgcatacctattctctttatatctttttgctcccggggtatgtaatcggagcttttatctgtttctggtggtttcgttggcagcgttggcgtttccggtttctgatagcgggcggaatgagttgttttgttattttctttggtgttctttattttggcattgcgccgaacagtacgtatgaaatgttatatctgcccatcttttttcgcggattgggtatgttgactttgattatagcctttgccttgtttgccgtagaagatttgaacccgaagtttttgttgtcgaatgctttctttctgataatcttccgttcggtactggcacctatcatggctacttctttttacagcaatatgctgtatcgtctgcaacagaaatatatatattctttgtcggagactatcacgactgccgacccgctggctgcgtcccgttatactcaatctctgaataatgcgcttgcacaaggacatagatatgatgaagcggtacagatagctacccattctctttatggaactttgcaggagcagagtctgttgcttgcactgaaagaaatattaggttatctgttggtgatatcggtcataatagctgttatctcgcgtttcattccgtttcataagacgattcgtgttacatttgccaagacgggagatgatatggtatagcatataaaaatgagtaaatcatcccaatttttcaattctttttcctatatttggctggtaatcactggagaacagattctctccggagtaggacagatctaatcttaaacacgaatttgaaatagatgaattatgatgaacagggctatcctcgtcttactattcctcttgtcggcactgccattttctttgcaagcccagatgccggacagtatcgttcgtaaattatcgggctatattgaagcagtgcagaattttggagaaatgctgccacaggaaaaagtctatttacatttcgacaataccagttattatcagggagaccctgtttggtttcagtgttatgttgtgacatctgaactgaaccgcccgtcggatttgagtaaaaccctttatgtcgaattgttgaatccgggtggggaagtcatagcgaaacgtgtattgcctgttaggaacggccgttgccacggtagtttcgaattaacacaattacctttttattccggtttttatgaggttcgtgcttacacgaaatatatgttgaactttggagaggaggttattttctcccgggttcttccggtatttgataagccacgggcagctggtgattttaaagaaaagaacatacagagatatgctgtttataaatatccgcaggtacggaaaaaaacggctaaggagaaaaaagtcaatctgaagttttttcctgaaggaggaaatttggtcgaaggcattccttcccgcgttgcttttgaggcaacggatgcctatggaaatccgatcgcactgtccggaacggttatcaaccgggaaaagaaagaaatcgcctcctttgccactgtacacgaaggacgtggcacctttgtgtatactcctacgaacggagagaatcataaggctgaggtggagttgaatggcaaaaagtaccgttttgatttgccggaagcccggttgcagggatatgtcttgcaagttgataatctttcttcggaagacagtatagcagtcagtgtacaaaagaatccgcatacaccggagtctgtcttaggcttagctgtgcttggtcatgggaaactgcttaattattgtctgttgaacatccggaaaaatacacctgtctctttcaaacttgacaagacggaatggaaggcaggggtggcacagatcgtattgtttgatacagcaggacagattattgccgaccgccttatctttatgagaaaaccggagccattgacaatcagtgtccggaaaaacaaagaggattatcagccgtttgatcgtgtcttattggacttttcagtacgtgacacggcgggtaagcctgtgtccgctccgatatcagtatctgtgcgtgacggatgggaagaagtggaaagccggcattctatgttagcggacttattgttaatgtctgagattaaaggctacgttcatcgtccgctctattatttcgaagcggatgataaagagcacagaacagctttggatcacttgttgttggtgcagggatggcggcgttatgcatggaaatacgagtcgggggtggaaccgtttgaattgaagtacatgcccgaacaagggattgaagtgcatggacaagttgtttcatttgttagaggtaagcctaaaccaaatatacaagtctcttcttttctggcgaagcggggagatgaggaaacttcgccgggagcgctttctcttaacctgtttgaaacagacagtgtgggacgttttgcttttattaccgatattattggcaagtggaatctgattctttctgtgatggagaaaggtaagcggaaagaccaccggattgtattagacagagtcttcagccctcaacctacacaatatccgctgggagaaatgcagataagcctgtccggcagagataaaccgggagcagaacaggaactacagacagatactgtgattggtgatgatatcgattataatcgttttatggatgcttatgaagattctctgtcaaaacggggtatgagagagaaaaatcaccgtttgggtgaagtggtggtgaaggctaagaaatggagtcgtgagaaggatatttatgaaaatcgttcgaagtcggttgcttactacgatgtaccttcggagatggatgatattttggataagggaggttatatcggtgaagatatccacgagctacttgtccgtatgaatcccaatttcatacgcaggtatagtggtggtgaggaatggttgcagtacaaaggtcgctctcccttgtatgtgataaactataaacgaacggaggctactgaaatagatcagacccgataccggacacttcgcctggtggctatcaagtctatttatatcaacgaggagttatcggcaagatgtcgttatgctgacatccgtatgtctccgatggatgtagatgaaatatatggttgtgctgtttttattgaaacctatccggaaggagagattcccgtaaaaggaggcaggggagtcagaaaaacttggttggatggctatagcgaacctgtagagttttatcatcccgattattctgttcttcccaaagaagaggactatcgccgcacattatactggaacccggaagtgatgccggatgaagcagggaatgctcaggtgaggttctataacaacagtcgttgccgcaggttaaaaataacggctgaaatgatttctgcggatggggctattggcatgtttaacgagtgatataaaaaaagagggtgttttgatacatttacatttgcagtattaaatatcacaacaaaatataagtgtatatttgaaaagtagagttgcagtgaactaactttgacactagtcttaaatgactataggctgaatcagactgcaactctctattcacagtcgcctcaaccagactatccatatcaaaatcaatattataatccttttctattttaatccttcttatttgattgaccaatgaatgcggtttcacccttcgggtcatctctatttccagcaacctttcgggaaagcgtttacggatttcatctatatttctcatgaaaagtgaatctttattttcgtagagagaattggcagcttctgccagaataaaagctcccaagctgtcgggatattgttttagtactgcttgaaggaagaccttgctttttccaaaactttcgtgagcttcagcgtgcatatctttggcagcttgaagtagtcccagttggaacagatactcaccggtaattgcgtttttctccatagcaagtgtttgtatgtatagggcggagtccagttctcccatttcagataaaagtttggctttcatgccgtaatagtcgggatttaaactgtcgattgccaaagctttgtccagaaagcggatgcattttcgggtggagtctacatcgcaagaagattccattaatgtcattgcttgccggtagaggctgtctgcctgaagattgatacaatgaggagtgatgtctactttagactcttgctgggaatggcaacctgtagctgcaataatcattggcaagatagttaataagaggcttaatttcttgggtttcatattcataattcttatcatccaattttataaaaaagtaagactggcgaagaactcgataagaaaatgtgtctaatctgatcttattttgttcttcgtcagtcttttcttgttttacttaaatgcctagctgttctcttgcccaggcttcatcatgtcttattctgtaaaggtatatttcggacatattccaccatgcactgcctgcgacagtataatccaatggatctttgtcacggcgagccgtaggagtaaatcggatatagttgtaagcttgctttccactcacattgtttttagctgtggcatggccaccgtttgttgtcggcagattgaattcttcattacccatactttcaaagaactcaccgttcatacttccatatattgttgcggcttttacgtcacctccgttattcactccgctttgacgtgcatcatattcaaaacaaaggtcctttaatggtttgttcagtttgatctggacataatgtgcttctgttgtaacaggagcattccacttggtatgataataagtattcaccttcccgtcaatcaatgccggtaaaccgcctccgtctccgacatgattagcattgtcggaaagcatatcgatagtaagagtaacacgttccatttcggaagcttcgccggaaatgcctgttattgttaccggactatctgtctccataccagtcggaccataggtgttgatagtaaatgagtattcacctgcacattggtaagtatcatctatgatataggatgttgtcttatagtcatttattaagatctctttattttctttcgtgactttatcgtaataggtaatctttatcttgttgaagtctacatcttcaggtatctcccattgcagctgaatacttccggctcccggagtagcagtagcattgatcacatttaaaggaggtgtcgcgataaatccggcctgttttactgtgactacgaactgacttggtactttgtcggtgctattggtactcttgaaggttatctttccttcacgaggttgattctcaacttcagtgttggctttaatgataaagctttcggagacatcacgcagtgctcttgaagcgggtaatgatactggagtgatccaggattgggcggattcttcgacttcataggtatatgacacttcaccggcaggagaatttactttgaaaggaatagtgattgtttctcccattgctttcacttcatagatcttcttgtcttcatcgatttcgactatataacctctgggttgttgctttatcaggaaagaagctgtatagctgtaattctgggaagactggaggataatcgtacaataacgtacgtcagtctcggtgcttttatccagcgtaaatttcagttcctgtttgtttacgtcttccgctgcacgcgtctttgcatcaaatgtggcaggttgctctgccagacgtatccagttgcaagtgtctggtataatgatattatccagattcaggttggtcgctacaggaattgtcaatgtttctctttctgcatctattatttctacatatccttcctgttgtagcttgtcacctataaggatggccggttctttaccaaactgcgagacagtgatggaatagctttgatgaccataggctacagtgatttctgcccggcgttgtttgtatatattgtttgcactggcagatacgactactttgccctcgtgttgtactaccttgcaccattctgcattggactgggcactccatctgtcgagtggtacattggtctgcacttcaatttcatgttctcctcccagaagtgggaaagtgataggtgcctgacttttatcaggaactacgagcgtttctactttaaactcggtttcgtaatcgggcgaacaagagataagtccggaagcaattccgaatatgcttgcgagcccgatgattaatatattttttttcatactcatttgatttgattacaagttatctactcttgggttaaattcatatcgtagtttggctttcacttcccggtaaggggcggtggattccaggcgatatttataatgcagacggaactctttgtaataagtggcacgtccgtcgggagtacggatagcgtttaacaggaatgtgttgtcgtaatcatcgattggagtaagttgtactacatcgaccggatccacttccacatcattaactctgtcatgcgctctgatggtaagttctctggcctgaggattctccggttgctgctcgccaatttccagaatgatactcttagatacaattctgcttcttgctgtcttataatcgccaagatcttcatcacctgccatcatgcgtaccgaattggcaccgatcgggaatacttgattggcatttgtcggtctacggacttcgggactaccactggggttaggaattacaatcgtactgcttgtataattgtagtaggtagaagtctttgtcgttgcgtaatagttttctttatagatacgcaataatacatgacttttatccggattataattaggtgttttttccggatctatcttgtaatccagaaaataaatggaatccggtgaaatcctttccagatttttcagatagatcggaaacattactttggaagtgcctgcctgaatatccagttccttattgggaaaatcatagcattcatcgggaagcagtttggcaaatttttctttttctatatcaaagttggatttgttgtatgctttcagcaaagagtccgattccagaagagctacatggtgtgtgttagggcttatttgtgagccgctaaccgtggcaaccagatagatcgtatctttttcttgtcctacattagccacctgccggtcgtagatcagactcgaattactgagtaagcctacttcgttccggtattgttcctggtcgaaatcgtattcattgcaagcactcaatacacctataagggtgcagagcattatattaaatttctttttcatattcagtctgttattcatgttttgatattatctgtcccatccgaaattctggtcggcattgggaaccttcagcaattcatcatggcggatcggtaagaataccattttaggcagtgcaatgcggtctcgcacattttgtgtattgatcgtcacaatattccagaatccttcattaccgttggcatttgtacggtcttttgtcacatccagtccccgccagttggagctgttggcatcttcgtccagataggttccccatctgcgcgtatcgaaatatcggtatccttcgttaaagagctctacctgacgttcattgcggatgattttttcaaaattgtctgcttctgccatgtcgttggcatctactcccggcaagccgacgcgataacgtatcatgttgaaatatttagccatttctgccggatcacggctaacggtttcctcaataagtgtacctgtattgtcggatacttctacggtcactgtaccttctacacggttcaatgcttctacatattccagtagcacttcaccataacgaatgatagggaacggtttagggctggtgacgaatgcgccttttacactccctttgccgttagcccatgagtcgtccggatgaatgtatttgacgggaacataaccgctgacactgtagtcgtttacgttatttccggcaccggcaattccggcattggtatcatcgtgagaataccagaattgctgattgacgtaggaggcgtcggtagaagctgaactcatcggccagtagcgacccggaaaacctatcgaggcatagaagcgtgccgaacgattggcgtacatcataggtacgttttccctcagtaggtatgtccccagttttttggattcgccggtgagtctgctgaagtccggttcatatggatattctgccgatgaattatgaatagtccgcccatctgccatcagatagcaatcaattaccctctgcggcacagacattgaaccccatccgccaaacttgacagggaatgagtgatgggtatagttagtgacgttactggattccatcgcccagatgaattctttattagtctgtatgataccttctcctgtgaacatgtcggagtaagagtgataaggatcgatattgcctgctccgtcagggaagttagcagtagggacattggaggccagaggatatgggttctgggcatctgcttccactgtatgtagctcgtatcccattttggtcagctgtttggcggcagctgctgcaacggcccagcgtctcgggtcatactcttgattgacatagtaggctccgtcgcttttacgtttccaggtcccgaaacatttacgggctgcagctccgccattgaaaagcggtgaagcctggaagaggcgcaaacgggcgatgagtgccatggctgctcctttggtcggacgttgataatagttgacgctttgctcatccgccgaatagatgccttgagttgccaggcggaattcatcgcatatataatctacagactcatcataggtagcccgttcgcgattataatattcggcaggttcggaggtgctcagttcttcatcgcccacgataatcaacggtccccagttcatcaaaagatgataataagcgtacccacgcataaagtgaacatatccgatataacgtcttctgtccatttcgttcatatcaggtacattgtagacttctttaagcattttgttacatcttgctacaatgacatacatgtcgtaccattggttttggataggcagatttctgctgttgatggtacctacggaaaattgtagtccccaaaattcatttgtctgatatttaagtgttatttcgtccgaagcagattcccccggattccaggaatttccccagatagcccctgcgtcgggaaaacctttcggagtgttccagagataaccttcagcatttttcttgctgtgaaagatggagtcttctttgaaagtagcttcgaagtatgggtctacatccagaaaattgcaggaactgagtagtagtgtacttcctactgttgctcccaatattattttgaataactttttcatgagtgttctatattatttttagaatttaagataaacctggaacgtgtaagttgccggtatcggataagcggccccgtttgcagatgcctgttccggatcaaaatacttcactttgtcgatagtaaaaaggttgttggcaacaaactccagatcgacagaagatagtcctgtcttttttatccatggagtcttcaggttgtacttcagactgagttcctgaaagcgcaggaaagaaccgttccgtttccagaaagaggaaagctgggagttgttcgtattgcctccgtaggagagacgtgggaattctgcatggggattttccgtagcggtggtgcctgaataccatgcgggcgtccatctgttcttgggattgttggccagcttgataacgttgccgagttctccgttatagaagggaatccatcctgcgtcattaccgagtcccgaacggtagtagtctacttttgccgaacctttgaaaaggaagctgagggttaagtctttccaatgaaaatcggctccgaacccatacattacccgagggagttggttggaataggacaaaggtactttgtcatcgtcattgataataccgtctccatttacgtcacgatatttgatatctcccggacgaatgcggccgaatccgctttggtcggcacttgtgttgatttcttctttactggagaagagaccttctgcaatatatccgcgaaggatgttaaagggttttccggttacactcagataatcataaggtaacttgttttcttcatagtaatcaataatattctgagagaaagtgtaattgccgcgtacagtgaagctcatgtctttattgatctggtggaagaattcgaagtttccgtcagaaccatagctatgcatttttcctacatttgatttcgggacggtaaccatacctacaaacttaggcagcgtcacacgatcctggaagatgtgatcacgtgtatcgcggaaaaagtcaacagtgacagagagcttgtcgtggaagaacttggcatcgataccaaagttgagtttctttgctacttcccattgaaggttgtcggctcctttcacagtttctgtaataccccgttcacgatatccccagtaagaggcggcattgtcattgattaatgtcaaataagggaaccggtcaccactgatctggtcattacctacctgaccgtaggagccgcggaacttgaggaagcttaaccagggaatggcctcattgacccagttataggatgtcggtacccagcctacagcaatggaagggaagaaaccgaatctttttcctttttcgaattgcgcagaacctgtgtaaccgaagtttgcatcaatgaaatagcaattgttatagccataggaaatgcgtcctgataagttttgacgccgttgaggaatggcattaatacccatcgcgtcatagtcccattgggtgttatgaacatcttccatgtaatataaagccaatgctcctagtgagtgcaaaccaaatgtacggtcccagttggctttggcttccatgtagtattttctgtatctgttgttattttgtgtatatttcatgttctctttggcagtacgcaatgttttgatgagtaccccttgtgaacttcttcctgtagcgcggtagaggtcaggccatatgtaacgtccttcattgaaataattgatattttcgctcatcgcttgtaccgacgctgtcattcctttcaggaatcctccgaattcctgttcaagtttgagtgtaagcatattacgctgagtttcatcttgcgtgtatccggtgttatttagcatgacatacggagaagcaaggtcatgttttccataagaagggaaggtaccgtctgaataggttttaggaaacatcagtggagttagctgacggactgctgaccataccgtattcgtgttttgtccacccgggctggtatagttggaaatatatccgtccagaccaaaataaactttggttgttttggtcagattcatgtcaatattggcacgataggttatttttttatatgacaaaggctttttgaacaggttgtcttcctgccggtaggccgctccttcatcctgataccctaatgaaagataatatctggctatgtcgcctcctccttgtgcattgatgtaatagttctgctggatagatgtgcgtttcattatttcatctatccagttaacatccgggtagaggtctttatccaaattgtattttatcagatccagttccagacgggagtaaaggtcgtcttcacccgacatggcacgtgcctcattggcaaggagagcgtagtcataagctcccaggtattcgggcagacgtttgatgtgcgatacttttaatgttgctcgtcctgtgatggtaagtttgcctgtttctccacgtttagtggtaaccaagaccacgccattggcacctcgggtaccatacactgcggtggcggaggcgtctttcaggatactgaacgattttacatcatcaggatcaatgtcttcaaggcggccctcgataccgtcaatcagcactaatgcaccggagctggctccgaaagtactgataccacgaatccagaagttggagatgttttttcccggttcgcccgaactctgcatggtgatgacaccagccaaccgtccgccgatcatgttgttgagggaagtaccgggagtactgagctgggctacatcaatggtactgattgcacctactactgatatctttttttgtgaagtcatacctgtgaccactacttcgtcaagcttggtgtcatcttcttccaatgtaactttgagtgtcatttcatctttagtcaccagtttctcgatagatttcattccaatagcctgaatgactaatatttggttggcatctattttgatactgaatttaccatccatatctgctgaggttcccactcccggtgcattcttaacataaatggtagtacccggtagcggttcaccggttttgtctattacgacccccgctacagtaaactgttttttcttattgtcttgactgtaactcgtcagcggtataagcgccatgatcagtacaatcagtagaaaattatttctcatattgtattttgtataaggttattcaatggataatttacgaatcactttgttctgtgtgtcggctacatatacaatagttccatcactgttgactgctactccgcaagggaagtggaatttggcaatttccggacctccatccttataaccttccgctcccggcagaccgataggtgtggttacggctgctctttctttcggcatagtagtatctattacgcggatgcaggaattaccactgtcagcaatgtacatttttccgtcgtcggtgaaacaaatctggcgcgggtgtctgaatttggcgttcttcagcaagccgtcttcccagcccttcccgttcataactccttcgtagattgcttttcctgcgtatgattctccgttataagtgtctttatcttccggagtgatcttggatacgtccactctccaaatctggtgaaaatctgcaagagatacatagagtacgttttcttctcctttaatagggctgaatgcgatataggagtcacttcctgctttgccgccgtcgcctgttgctacattagatattttctttagcaaaatttctgctgtacggtttttaggattgattcgaaccaattgccctttccacatgaccgtatagatcatatgatccagcttgttgattacaaagcaatgcttccagttgttttcgtctacggtgctgagttcttctgatttcaagactgttctatatcggggaacataatttagaagtttttgcatatcataatatttcatgccggcatcatccggaatgtaaacagcttcagcatctttttcatcagaataagcaggtgcattaatatatgcagttccatattttaatacaatggaagaattgctggcgatggaaatcattgaaatgtttccgtttacgccttcacctttttcattacggcaggttgtgtttggttgtttgtcttttccactgtctcctttacggtctaccacaaatatattgtcttcaccgtctatacagagatagaaaggagaggagaaagtacatgtggcaaggtcaccaccaacggtgtttatattattgtccggtgatgcaagtcctgctaccgtactaacactggtttgtgtcttgtataggaattggtctggtgctttgcctatgtattcttgaccgtcgggcgttcttctttctacaagaatattcatctctcttttgaaggtgagtcctttgggaacaaatgcatagattctgctaccgttactgctgactaatccggcaggatgtctgatcccgtctacatcttcaaaatagactttcatgccagtggtgtctgtaccgaagttgcggccttcgatgatcatcggagtggctatacctccggaatcaggataaaattctgtgatctcaataggctggtttgggttgaacccgctgcttccattgatgtcgtcatctgaacaggaagctaaccacgcgaaagctgtaatgaacagcgtccaataaactcttctttttcgcattgtttttctgtgataaaaggttaataattagattggttaaaaaaaagtgatagggaaacctactcttgtgtgtctactatgtgggtagaactagggtatgcatacaaggggtatacgtttgtttttgtatgtatgagtaagtttgaaaatatatgggtgtgtttgactgctattattcatcttcttaaattgggggtattgaagttgataatgaactcagaatacatatcatacctattctgatctgtgctgaaataaaagtaaaaaaatgagatcgaattctccgattttgaaaggcggagggctgttgctaagagttttcataaatgttaatttaaggttataatcatattgattaattggggctaagtcgtaataggacttggtatttttataccccaaagtatattttctactgtttccataggctattcaaaggttattaagtgcatgtactattctaagacggtgtaaagttattaattagtttaatataacaaatcatgtagatatggcaacaataaaaatcaaattccgtacctcttccgtgaaaacaaaagaaggcgtattgttctatcaaatcattcatgccagagtaaccaggcaaatcaataccggctataaaatttttccttcagaatgggataagcatttggcttgcatcattcttccggacaataatgacataagacgacgttttctcgctcaactaacaagccgaatagcagaagacatgcatagactgaaaaatatcatttcaaaacttgaacattcgggcaatccttttacctccggaaaaataatagagctattccgtattccccccatcaataaatacagttttctatcattcgcacaagatcttattatacaactaaaacaaatcggcaaagaacgcactgccgagtcttatgcctcagcatacaacagtttcaagcgttttatggacaataatggtgacgttctacttgaagatgtaaattccaatctgatgataaaatatgaaatataccttaaaaactgcggtgtctgtccaaacagctgttcatattatatgcggaatctccgagcaatatacaatcgtgctgtagaaaaagagttaacacaacaacaatatccgttcaagtatgtgtataccggtattgacaaaacagtaaaacgagctgtatctctaaaaacaattcgccaaatacaaaatttagatctgagcacaaaccctttgatggattatgcaagagacatcttcatgttctcgttctacacccgcggaatgtcgttcattgacatggcatatctgaaaaagaaagatctgcagaatggagttctgtcctatcgcagacataaaaccgaccaacaattgttcattaagtgggaaaagcccatgcaaaaaattgtcgataaatataacactatagaaagctcttatctactacctatcatcaaaaacaacggtaaagacccaagaagagaatataaaaatgcctcacatttgattaatagaaagctgaaggtaataggacaaatgttagagatccccgtcacactaacaacatatgtcgcccgccatgcatgggcaaacattgccaagagtaaaaatatctctatctcggttattagcgaagctatgggacatgactccgaaaacacaacacgtatttatctagcctcgttagacgcctccatagtggataaagcaaacagtattatacttaaatcattatagtataccaaaagagtattgacggggctgacccaaaagtcagcccttagttttccaatgctacattattaataaataagattatcatggctctacacaacggataaagcatgcatcacttttaggcgtttctattttattttcaccagtaagagttgcgtaaacattacttttagaaatcaaattaaaatcaaaagagaagtaattaatatcccacgccataatatcactttctccatcgcgccctggtggatatatctgctgtaaccaatagatagcccccggacgcatatacaaatcataaaacaaaggtttctcatcacctgccgtcatattgaatttatcactacgtccagcagaataacggagtacaactgtattctttgtctcaccatgtatatagccctgaccagtaactacgccctgccaatttttcatatcaccatatccttgttttctatgtccatagcctgacgctcctatcggaaagaatagattccgcccatccgttttattatatataaaacaaccacgcataccatatgtgccgaaactatcataacgatatccgtatacttcattgatattggaaagtgtttcctcggcatcatcaccatagagtacaccatagcccatttctatatccttgcttttatacaatacattataatcatcgtaattggcaatttccacttcttttccattaattttaggcttttcaaaaggggtattaaaaggctgagatgtgatttcatcccacaatttagtagtcccttttccagcaatctctagtggcttggctttatcatctttaaagtctttcggctgcacttctatccaatattctttctcatgtttattacttgacgcatcaattggttcattcagatttccccacttaaacaatgacccttcttctaccggcgaatctgtttcctccgtaggagtcttcatattaaacgtatgccaagcccgcccttcgtcaagcaaagctacaggagcatagccctggcggacaaatataaggtgattgcaagtattgttgtgataactgacacgaataacggcatggcgggattcattttctgcacatgtaccattgaacgtaattttgaaatcaattactgaaccggaaagccccttaagtgtaccatgttcatctatactcgtgtacttgttactactacttttttctaacttcacaaatccttcgtgcgttgtcgctgcaacaacagcttcccaagccccctcggaagtaaattcttcgaaatttgtagcattctcccgtgccaaacgttttaaaacaacatggaaaggcttgtcattattatgccgtcgatatattcctttaggattgactacgcgacgtacctggaatatatcaactatttctgttaatggctcaccctgcgataaagtcgcggttatttttatttttgcctgacgccggtaggctacatatggattattcccggtataactagtttttgcaatcatctgtttcgcacgtgtatataaaggtatactcatatgaagtatattcgtcccctcttctttacgcacagaataattaccatattcagtatcttcgtgaatgcctggatctacggcatattcgcgatttcctcgttgagttcggttatagtattcctggttgctttctgcataaacaatacctgaatcctcattagcatctgcttttgttgtcgtaagtatggttgcagtagtacggcgcaaagaaagaaatccattccatacattcttgccttccaaatcaaaatgataataatcaaaattattagcatctgcaccaataggcgcccaaccattgttgagtatttccgctttcacactttccactttcgcataaccaggatttatttttataggcaaatccatcgttctgttatataaataggaaatataatagggattgggcacctcaatacctggttccggttcagcatattcgatatgccagtctgcatcatttgcaaaatttttaaatttcaatgtaagtttatagtgatgattacgttcggcatcatagtttgttgtaatgtttttaccaagcataaaacggtatttaatatcaccactacctactttttcttcattaatagaacgataataagcgtctacttcaatatatgtaccataaggtacgttatcttttggtctatattttgaataatctttgtccggctgttgcagatgaggaggtaatccgggatgatccagttctttatctccatctgcatcctggcgtttatcatatggctggtccccctgcatattctcatagaaaaacaaagcatcagctgcctcttcgtgtccatatttaaaagttccattctcttcacacgggtaataagctctccccgtagctaaacgtaccggataaaattcgtcaaatgcaggtggggtagttcctgtataatactttatgatttctccgtcttttattaaagacgattgttcatcttcacttggtgtgtttgtttttcccaagtagcaattaacaggaatatcctttatctgaaccgatttcaaataaataaaaactccttctttcaatccagtggcatcataagcaatggttactttggaagctgcgcggcgaatccatgcgtgcaattccatatctttcttatttatagctactcgtgaagcttccgtattgcggttagcccccgcaggtgcattctcttttgttgtgaagtagccaaacatctgatggtttttagtagctcttgtcacttttccatcagcagtttcttctgtcgcgaaccagttttctgcttcccatgtcagattaatcgatttcagtttatcgactgtttgtatattatctttttctaactcagccaagttacccatatttgctaccgcatacatataataatagccgtaaggaacttgagctaacttgaaggtagcccgtttggttttggcttccgccgttttgcctccttccgcatctgtgtctgcacggtcaatatcatcaacatcgaatctatctgtagtttccgttgaagcagtacctttcggaagaagatagtacgatttcaccagatttccttcctcatcatacagcaacacacaaagatcattgatgtctttgattacatctcctgccgtacgagtgtttacatccagagccggccgaagaggaagaaactctacagtagcactcacactgacttctccttccggcattctttcgccttcgttgttcagccaatcatccgtacaggcagtcaagacaaatatcagcatacctgtaagactataaataatgttgcgtttcatattttcctgtataaagttatttaaggaaatctttcctttctttttttataacccgaaatcgggttctagtgtgatttcggtataaggacgcacatctactatgcaatccattgcatgttcattaattgtgatatttaccaccacatgtgtatttcgcggcaactgtggcagatttggcaagtaacttttcaattcagttccgttgacacccaaagtcagcagataaggattttccttattgttgtcatcactatgcttcccctccaacaggtaaatcggttgctcattggttttcgtattttcatctcccggaagcagttgccctttaaacaacgatgacgcatcgtatgtataataccctttcaaagtaggaacatcgaaactatttatgtcccagaactttgttccctccgtcgtttctctctctatatatgtagcattgtgtggcaagtaatactccctttctgccattttatcaatagtcagtttcgtgatttctatggaccgactgcttttattcgttatattgaaagtaaatttaacagccgctctcattatggaaagctcacgttcacaatcctcggcaggcacatctaccatataaagtccactcatcggcaacggaccgtcgattcgctccatattactgcctaaccgaatggtcagactggatatataatccgtaaagaataagcttccgggctgaattttctcaaaatcacactctaccaatttacgtttcggaaaaaatcccgttgtctttatttccgtagcttcatttgcaaacaaataaattcgtttcttttcgtttccgataactttcatcggctcgctataacaatcggtagatgcaacctccaaattgtaaatccggttatgttccactatattatcattgttacgtacgacaataatacgcaacgttttcatcttttcattatcatttactggagcctctggatagatgtcactggcccgtgtacccgattgcgatatgtcagacagggcaacactgatattaagattcactaacggcacttccctgtcaaacatttcactatctgcatcatgagcacacccccgaaaaaggagagaaatagcccatggtataatgatatatgcgattttcttcattgtcttatatcgttgattctgacagtccaatcgtttatcttaatataagttttaatccattcaagattcgggcttaagaagaatatcattgaccattcactttcacgatcaaggaactcctgcgaatccatgcttgcatacagatcactcttaagcataagcaaatagttaataagtggaatattgataatttccacaccatctgctttgcgacgcaccgtcagcttaggcgagtaccaatcacgcaccatcaaccgtgaagtagatagttcggcataagctaccaccacttctcttccctcatcagtgaatcctgccgaagcttgcccttgtgcccatggagtgtatgtcaccataccattctcaagcaaattattatcgtaactgaacagtatattatcatcggtaatttcaaattcaaatttcttatcatctaccggctcaccattcatttgttgcaacacaacacgaatattattggtgttcttcatcatctcaacagtgccttcactgtaaaggtcggcagtagcgagagtaagttcaccccaatacaaaccgtgcaagttctttcgtctgggatttgtcaagcattccgaatctagttccacttgcaaatcggtatatccagttccttctccgggggtatacttcataaggaaagagctcttattacaagccagaccaccataagctacgaaatgataatttccttgtttgaggtccagcttcatgcgatagttctcgtcctgcaactccgtacccgtcactatgcgagtatccacataattgccattttcatcatagaccagcaatgtcagacaatccaccttcttagcaaatgcattggcatattccatattgtagtcgtaaatgaagcgtagtgacacgccatgcggacatggagcaagatcttcatagatacgctcacacgatgaaaaggcaaaatttatcagtacgatgccaagcaccgtactgataaaccctgaaattatatttcgttttttattatgcatctttggtttcttagaaatcgatattattgacacgaactacccaaggcaatacatctaccgaaactgtcagataaatatcacctcgctcatcgggagtatcaggacctgggttatcagggtcattatctgaaatacgtggatgcccaagacgggaaatgttagttacagcaagtttataaacattgttgcgaactacagcgaactccatcggagccatttcaccttccacaccattgtcattgtggcgattccaataataatagtagcaataatagccccaaccaccgtctttgtcctcgcttgactgatagatggttatgccggcatcagtagctgcttgtctgaaatcactgagataagaaccttcaagtgttttatcgtttctgtcccaagtgttccattttgaattagcactactttcatcttgagggctagcatccccttcctcacctgtaccaccggtaccatatacagccacataaagcggatgagaacgactccatgttttggtctcttcgttgtatgcaacagctttcactgcttttcgcacatttggccaacttacatacaaattgccgccgaacatataaataatcggatctttataagaatccttcattaaaccagaagcagtgtaattaataacttctgccaagtgcctggtatcttcgtcagtgctagcggcagcagcttcagtagctaccatttttcctttgaaaacaataccggttgttataccgtttacctgcctgtcaaccggtcccggaattgtattttcagttacataccgccatatacgatagtcaccatatttgttaccagtattccagctattatctgtatcttcttcacccccaagaaccgtagataatagatgcgtgttccattgatcttgctttgtattgtctattgagccgtcaggttgaaagagagggtaattaaaatactcacttaatttcgtagtctcaatgccttgattcttctcggttgcccacacatccacgacataattaccattaagatgagtttccccacctcccacagcggtaaaccagggcttttccgggctgcaaagactagcttgtgccggaagtccattatcagatacacgacgcaaataataaaaactattattcatattcaccaaagccattttacctaattcaacgtttacaatgtaagccccaggtgttccgtccggcgcaatatcttgtacaaccggataagtgttgcctttctgaggacgtatattttcaggcaaactgcgactaccatctctaaaatcgaaacgtgccattgcgcgttctactttcactgcaccacctacactgttgtctacttgtgacaagcttcccgcattgtttattccggaaagattaaacggagtggcttcattatataacaaccagtcattcatcgtattagggagcaagcgcttagctatggaatagttggacatcagaaagctgccaccttcattcttgctccatatctttcctaattcctcatcgtcacccttgcaaattgcattataccatgtcgtattcttatattcagttttactaataagttctaccaattcatctgtcgggttacaaaatataaatacattcacttcctttttatcagttggtgtttctgtatcattatagaactgagacaattgcgttttagttatttcggaagtcccaatataagcctgtttatttgcggattgtttcatcttgtccgacatgtcaccaaaagcaatgaatgcattatccgtgctgcgggcaagtaccacatacattcttttcacattgttctcataatctttaccgatttcgacaccaacattgctgccaccaccttcaaccgtattactacgcgaaccaggcacagacggcatagttacctgtactgtcatgtatgccttatctccctcataaacagtagggtcaaattctgtttcacctagtttatcctcagcacaacctgctgtgagaactacggcaaaaaggcataaaaaatacttgctaattcttttcataatctgcaactttgaatgaattaataatttctatgtttttatatttagatcctgttaatgttttatctcttctatttgctttaacatctcctctgcatcagccagccccctatgtgcagcttcagtaaacattttctctgccatatcaaactccttcttcaaggcagcgtatgtcccccgaccataaacagcctgcggtgagtttccagctttcttcagataatattccgcattcttcatatcccccctagccattgcggcatttgcagcattcagattagccacttcatcatcagggaacatacgtacagcgacttcgaatgtttcattatattcttcactccccagtttcatatcctgtgcggcaagatacatctcattcaaacttaacttctgtggctgtgttttaatcagacgcttgatttcgttgatatcagtataggtacgcacttcatatttgactgcatagtctgaatgacgaagccccggataaacctctttcagtaagaatgcataatcttttggaaaggcagtcttgatgctacgttcttttgcatccggttcctggttactgcggattaatgccagaatacctgctttgttttcgagatacgagttttccacataacgttcgagtcctgcccaatcttccggctcgttatcggtaatgaatagtgaatcggcaaaatcgtactgtttgcgtacatactctttcaatgttttcgttcgtcccatcgccagacgttcattattcgaatagggactttcaggcgaagcatatcctttgatgctgacagagataatccgtgtatccacatcattcttcaccgcatcaatagtattaagtatcttttgtaattcagccggattacgacgataattctcatggatttctgttcggttcacaggaaagtcaatataagccgaaccttccaatacattaatttttggttctgctttcggacgaatgtatacataggcaggcacaaattctttcggctccaactgaagcaccaacagaggctcgttgccatcaacaagtgcctcgccgcaacaaccgcatgtttcattgcccgtactgagcgtggcacgtttcatccaatcggcataaggtaccactgtacgatatttgaccacagatactttgcttttttgataaagcatcatatcatccgtacacaagccattgcgcagatgatgataatagcggttgcgaccagctatcatcaccgaaggtaagttcagttcattaccttctcctgacagtctaggcgtaagaatcacttcacggttactttttacactcaatgccgaaacatcaatatccattgatacgaacaatttatcttccgaacgagacacggcaaggtcagatactgtcacattaccgcccattattgtttgagcctttgctcctatcatcaagagtaggaatagcaaactactacaaagtatttttgttgttctattcatatccgtaatttgtgtgatttaaaaagtatatatgagattgactgccgcttttgtgggcccaacataattatgcgattttccatcggctatttttgtaccgcattgggcacagggataactgtcgtagcgagtataaatccagcccaaacctaactccgcttccaaattccaacgtttgttcaatatccacgcataaccatacgcaatgccaccaccggcaaaccaaccttgataacgacgatcagaaagcacagataaatctgttccaagaaacgaaatatgattgttcagattaccaatgttatactgcccacccaaagcatgaacaccaacaaaatgaccagcgaaacgatcacaaaaccaataacgtccttctggttgcagaagccaatgtttccacttacgctcatgtgaaaaagtccagccattatagttagcggaaagatcaaatgtccatttcggagcaaggccaacttctattcctgcattaacagttgcagtaacatcatacaataaattgcttttgattgctactttctgacaatgtacttctgtgcagagaagcacaaaaatcataattgcatacagtttcaatttgttttttttcatatatataagtattatatattactaaattcacacatacacgcatatatctcaaaccacattcgtcctatatatcggaaatagaaatattttagacatgcgttatatatcaaatcaatgttacatataccttttcaacaccccgtttaaaagatgcaggtaacgatttggtgatggaagtcttgcttcgggttacactgctttgcatagtttcaaataactcatatacaaatgtaggcaatatttagaatatagcaaaatatactgccatctatttttgtataaatctgattattaacatattaatgatttaaggcataatttattgatgcttacttgttatagaatagccggggacagtgcctcccggctattttcttgtcccaaattggcgttttctgtctttttttggcggttgctcaacggttgagtaaccaatggccttataatatctccgtaatattgcaccataaacaataaaaataaggtcattatgaataacagaagaactgcaccgggtggacagacaatccacatgcttagtgccatacttgctaaagttactaacattgaaaagttattggctcctgccgtacataatttgccggacagcgagatactggattcaaaaggtgtgcgcctgctcaccaaaatgtcggacaggacacttttaagacgacgtaatgacgggacacttccctttcacagagacaaggggaagatatattaccgccgctcggacgtgctgcgtgccatgttgctggaaaaagaagaacactctaaaaaataaatgttatgaagaagatgattaaaattgaaagcggttcattcgctgcactcgtgagaagttataagaagtcgttgaacatgctggccgtcctgcaacatatctgtcaggaaaatgacgtggcgctttccatgctgcctgatgaagtctgcgaactgataaatcttgatccggcagagattgagaaacggcgtttgagcggacgactgcgttttgcggaagaagagaacgggacaaagcattattcgattgtggatattatcaacctgaaagactcgattgactggaaagtaatcaacaaacaggtggaaagcctttcctttgaggaaaaggaatgatgtaatttacggctgacagacaagggcacggtcggcaaggtcggatttatccgggtgccggccgtgcctttgtcctttcctgaaaagcggctctttgctgtaacctgcggaagtggagcctgcgtagcttccgggggttacagcaatgtgccgcaggaaacattaggatatttttttcagttcccttgccgggtttgcgatttccatagacggtacatgtttagcctgccgtggtaaatccggagtcacgtcactgccactgacaagcctctgttcttccgctcccgtttctttaccttctacatttccatgccgtcctaccggtttaagggtaagctgtatcttccggttcaatgtggcaagctcttcacccaactttttgatttctccctctttgggccatgtggctaccactatttcctgcaagaccggaatatcttttgacaactccgcattttccttttcccgtttctcaatcatgccgggaatacgttccagcgcattgatgaaatacattacggccagtttcgggtctttggcaatgtaaccgttatgataggtatatttgataccgtccagtccctcgaccatgaatttgttatgcaaggcttgcgtgtctccgtcacaagtcttttcggtacggacaaggatacgaaaatcgaacagagttccgattttcatataatcgtcttccgttcgggccttctgattgattgcggcaagccggttgccgagtatctcgatattgtccgagtccacaccgtccagtttcaggggattgggacgaagcccggtttccgtatctaccggagccactttattgaggtattcccaatctctggtaaagcgtccgataaaaatgttgttcttctctattccggcggtcttttcattcagctttcctttcgcgtttcctttattacggtgatacgcctgcctttcactttcaaggactgccagtttcttgtccagttttgccttttccaacaaatcgtcgttgcctgaaagaatagccacatattcactgaaattgcctccgccgttttcgtctatcgccccttcgtcaatggtacgggcggccagattgcagcttttaagctggttgatgaacacctgcttgttttgcagcagattgaacttgtaactgtccagagatttttccaccgcatagatgtaacagtccaccttgttatcggcatattgcttggcgatgatattgccctttcttaccgcccgtccgttacgctgctccaggtcggacggccttcagggtatgtccagatgatggatggccacggcacgctcctgcgcattgactcccgttcccagtttctgtgtggagccgaaaaggaaacggatgcgcccggagttcatatccttgaacagttccttgcgtgcgttgtcgctgtttgcttcctgaatgaactttatctgcttttccggaatattatggtcttccacgagtttacgccttatctcactgtagatgttccactggtcgggtttataggtactcaagtctgaaaaaatgaactgtgtgcctttctggtcgagatatttatagtaatattccgcaatcttggctgcacaatgggacgccttgtttcccggattatcgccgtattcagggtctatcagccgcatgtcaagcgacatcttgttcgagtagttggtggcgatcagcatctgtgccttttcttccgccttggacaaaggttccctgtctatgtaggttgcatccccggtttcagcgaactttatcagtttctgaatgaaaatttcctgctggggagtgggcggtatgtgatagagttgctcgttgagttccggcctgtcaacccctacgtcttcggccgttttgtaatcggttatctccgcataaaaattggcgagttccggcactttgataaaatagcggaaacgctctttctgcacgacctggttggtcacggaaaattcaaagtccgtgcttttcttcgcatagacggccgcccagccgtcaaagcaggtgatgccctgccgctccatttccttcggacggagatatttgaaaaggagatagagttccgtcagactgttggaaatggtcgtaccggacaagaatgtggctcccaagtctctgcctgtgcgctcctgtatggtacggatggcaaagagcatgttcatggccttcatgcttccttcgggattgcccagaccggaaactctcgcatggcgtgtactgaacatcaggttcttgaaattgtgcgattcgtcaacgaagagatggtcgatgcccatttgcctgaaatcggtcacgtcatctgtccggtcttttatatcctgttccagcttttcaagtttggcctcaaggttttcctttcttctttccagccccttctttatccagccgctcacttcattgccttgctgctcgaatacggcgagattctcttcgatgctgtctatttcctgcgtatatatttcctgctgtatttcgggggactggggtattttcccgaactggtcgtgtgtcaggatgatacagtcccagttattatttttgatgtcatggaatattccgacacgcttctccggcgtaaagtcctccttgcccggatacagcactctggcattcggataggccctcttgaacgtgtcggctatgtcatgcacattgcttttgagtccgataatcatcggcttgttcgccagtccgagacgtttcatttcaaaggcggctatgcacatgataagggttttgcccgtacccacctcgtggtcaattatgccacccccgttcatcttcagcatccatacggcatttttctggctgtcgtacaaggacggtatgcccagccctttcaggtcaaggaacgggaaactttgcagggaaccgtcataatccgggcgtacatagcagttgaacttgcggttgtacatgtccgcaaggtgttgtttaaattcggggagctgttcattcagccagcctgtgaaagcagaccttatttcattgattttggcgtcggcaagctggatggcctcggcatcccgtacctttatatcattgccttcttcatcctgcacggtttttgttatgtcgggcaccgtgttgtgcagcgcatgtttcagcaggtcgtttccgtaataacctcttttttcccctttcacataatatctgtcggtgatgttcgcgttcgtttcttcaaaactcacactgaactcgtcgatggattccgtatagtggatatgggcttttgcctcaaaaagataaccggcaaactcttcatatacggatacgggtatccacctttctcccagattaaaatcaagcagttcgaaactgatcggctccggtatggctttctgcaaggcttccaatgatttcttgcttgcgtcgtcatcgggatagtctttcaggtagttctctatccattcgactttggccactacattgcccgctatgaaacggtctttgatttcatagttcttcatcataggattgtagaagatacggttttccagttgtgtgagcagttcctgcctgcctgtttcactgagattttccatatattccagattgacttccccgaacttgttcagggatgccgcaagcgcttcctgcggtgtatccacatgtgtcacttcattggcgttgaacgatacgggaacagaaaagatatccgccttctgtatcttgccgttaacggaacgttccaatgaaagtatttcccgtcctccggcatccatcagcaggaacttggcattgtcctttccgttcaattccctgaacatgcggtaaaaactgtcataccgcttgaccagttcttcccgtagttccggctgttccgtttccgtttcggcttccttattgtagagattgtggtaggcttcacggagcgggatatagtaggcggcccggtattgttgggtgactgtcagtttaagcggatggaattgtacttcgggagtacccacccctcttaaatatccgtattgctcacccgatttcacgatggaaccgttcttgtattcgggacgtgtctctccggtaaacggtcgtggttccatttctttcttccgctcttcctcgaatttttgtctgcgctcctgccattttgcttccgctgccgcccgttccccggtcatgtcttcctgcgtggcggcttcatcgtacatgttctcttgggagaagagattgaacatttccggttcatcccctttctttttgcgggatgccgacggtgcccggcttggtgaaggtctgctttctaccacttgcacctccgcttgctcttcatccgcataggcggcaaacaggttgagcatgggttcatagggctgtgcggggctttcttcctgtacctcctgccgttctgtctctcctgctgtttccaatagtgtctcaaactctgttttgaggatggtggagccgtttgagcgggatagattgtcatcataaagtttccggtcaagatggttctccacatcttgcgccaataactgcctgagatgttcggaaatggcaccgacacctccttcatgaataaaattcatggccggttgtccgtacatgtttttacccatagatacggaagtatggacgatatggtctaaatcggcatagctgttgttgatattgatgctgccggatataaggcgggtttcaataaagttccgttccttttcggtaagttccgattttcgggtattcttctgcaatacgatcaggtcactgctcacttccgtacccgcatcaacaaacaggttgtccggcagacgtatggctgaaacaagattggcatggttcaccagccactccctgacagggcggttctgtggcgagtccatgacacccgaagtcgtgatataggccaatatcccgccttcgtgtaacgtgtccatacctttgagaaagaaatagttatgtacggcagcaagtgaggatttacgcacgacgtcttcgctccggtcaaaatcccggtcataaactctggtatttccaaacggtatattggatgaaaccatatcgaagtagttattataatagggctgtatggactggaaaccgtctatggtcactctgctttccggatagagggatgagaggatttttcccgtgagcttgtctttctcgaaacaatggacttcgggtacatccttcaagccgttgataaacatgcccgttccggcagaagggtcaagaaaacgtcccggacggattcccggtacctgcaaggattcctgcatggccgttaccaccggttccggtgtgtaaaaggctgtgagagcggagtttttgaggctttggacgtatgccttgtattctttcccgtctttggaatactcacgcaacagttcatgcagcagtcggacttggggaaacaattccctgtctgtcgttcatttttcaatgtccgtgtctttttccgccggattcaggatgcacttcagtcctccaaaacccgaatagccgttcaatactttgcgtgcctcttccgtgagacagaactccggacgcatgaatatccattcaagtgcggctatattgtccgctaaatgttgtcgtttgttatatgccatatttttcgatatttgattggatgaaacctgtcagttcaatggtaagggtacgataagaaggagatgtctcaaacctgtcgtctatagggtatttcttgaatacggcttccgcaagcggcaatattttgagacagaaatctttccgccgttcagagggtatttcaggaaaccattcggaaaccatttcaaagaccgtatcgtactttgagaatttgagtccatgctggagaaacgcatctgccgcttccagagcttgcgcaaccggcaggccgccgcgtaccgcatgttcgtaagcctctgcggcactgttcgcacgcttctgaatgagcaccttgtttccggccatgtgcggatggctttctttcaaataaaaaaggagagctgacttgaaataggacagttctccgttgttatcatgttgtgtaatcatcatctgttgttattattaaagattaatatgatagggaagtaatcggaaatatacccgataacctgagaggaaaccgggtatatagattcggtaaacgttctgttcgttgtcggattatgagaatgacaggctgctctttctggcctgcggtctggaagatacgacatgacgggccgtttgtttcgtctctttcttcttgtcattcttctggttctcaactgccggcttatattcacgggcattgcggcctatcaacaggttgttgctcttgttgctgaatcgtacatcatccgagaaaagttgcctggtcttggggttgcgcatgttttcgatgaataccatgccgtgattttccagtatctttttctgttcgggggaaatcttggctcctaaaatcgtatcgttgaccttcaactgcttgtcggattgtttgaaagcaatgtccctgatggtcggatcaacataagccacaccggagagcatggtgtcatttttgcgctgtatgtcattgactggaagctcacctcccgatgcaagtatctgcttctgcttgtcgtccagtctctttccataaatataatccgggattttgatggcatccacgggcatggtgatgactcggttggtagtctcgtggaaactgacataacatttgcagacatttcctgtaagggtgtccttcatctccttgatgcctcccaatgttcctgtttccgccagcttgttcttctcttcatccgtaaatacacctttataggcgggcgaatcatattggggcttgtccagacgggtgaggattttgagttccaccttgccgtccgcacctttcacgcacatgaaacaggcttcgcccatatccttcttttctccgtttatttctttgctgataggcaaggcggtggaagtgattctgcctttgagaaactcgcccatgcaatgattgttgaacagtgtctctttatcaaggccgagggcgttcaggtctttccacggcagttggtgttcatcaaatttataccgtcgggcaagtttggcgatacgcccttcatcgttgagttcgctgttttccaccagcttcttgccgtccggtccgggatcttccccttttcggatttggatgaccgcattcagcgtcttgtccaataaggcgaaaggaacgaggaagaaactgaaacttgtgggattttcatactggttcttgaagttcgtgaaaaacagttccagtggtgaagtacggtccagtttgagaaaactgttgctgttcttcttgtcgggtggtacgacttcgatactgccgtcctgctcgttcattttggaaatgacggcggttttgttcgttctcttgtcaaggactgccattacatgctcgtcctgactctgctcttgttgttcttgctttttcttagccataaattaaaaaattaagtgatacaataaattaccgggtaaactttagcccgtcggtgcgaatgtagaggtttaattaatagagaattaggttttggaagtagtggaaatgaatggcgggaattggctgcaaatggcgtaaggtagtacaataaaaaagagggtatttgttgtcgttttcttctgtgtctaaaatattaacctcatcttctttctgttgtctttctttttaacttatctgttgatttttctttttttcttcaaaaaccacaaaaaaagaactaataggttgattgtaagtactcaaattagtgccataatttgtttgatgtgaaaatcatagcattcaaattaatgttttgattttctttatttttgtattgatattctaaacctttgtttatctttgcaaatgaatcaatagcataaatatgactatattaggaaaatatttgtcggaaaaatctattaataaagccgatgtgtctcgtaagacaggcattagtaagtcaagattgagtgagttaagtagaaaagaaactgcaaaattaaaggcagatgaagtttacttaatagcacttgctatcgacgttcctccagaagaaatcttgcaaaaagtttgtggtcatcttaaattaattaagctataatgaaaaagcctacctatatcgatatatttgctggatgtggaggtctttctttaggactccataatgctggatggcaaggattgtttgctgttgaaaaaaatgcagatgcctttaaaacgcttgaatataatcttatagagaaagttaatcattttctatggcctgattggcttcctaaaacctctcatgatattaatgtcgtcttgaaagattataaagagcagttgttaggtttgcaacgaaaagttgatcttgttgtaggtggtcctccgtgccaagggttttctatggctggaagaagaaaggaaaatgatcaacgtaataatttggtgaaatcttatatcaaattcatcaaaacaatacagccaaaaataattttttttgaaaatgtaaaagggttcaccttggaatttagaaaaaataaggacaagggtaaagagtattcatcttatgtcgaacgcgctttaaatagagcaggatactacgtaaaaggagaacttgttaattttggagagtatggcattcctcagaaaaggacacgttttatattagttggagtaagaaaggatgtgccaaatgtgtctaaagatacggcttcgcaattctttagtctaataaagaacaatcggcattcttttttgtctaaaaagaatttgaccattgaaactactttaggagatgctatttctgatttattaagagaaaatggagaggtagattcacctgatacaaagtcatttaaggcaggaatgtattcctcaataaaaagttcctatcagcaattaatgaggattggggtaaatcaatgtattcctgacagtcatcgctttccaaaacatcgccccgaaatctcaagtaaatttcaaattattttagatacctgcaaaaaaaataaagatatagactcttacacaagagaacgttttaatataaaaaaacatacgataataccattagatgagcaaaaaaagagtccaactattacaacgcttccagatgattatattcattattcagaacctagaattttgacggtaagagaatatgcaagaatacaatctttccctgactggtatatttttcaagggaaatacacaacaggaggtaaaaggcgaacgcaggaagttccacgttatacacaaataggcaatgctattccaccattgtttggagaacaagtaggaattatcctaaaaaaaatgatatagaaatggatttacattttaaaacaaacatacagctcaagagtattattggtaaagatcttatcaatgatgacaatattgccattcttgagttggtgaaaaattcttttgatgcagatgcaaagcgggtagatatttcattctcaaatttgaaagaaaatgatgataagtcaattgattcgtattcagaaaaaacttcacgcttaattattaaagatgatggtttaggtatgaatctagatgatatcaagaataagtggctaaatattgcatactcagaaaaaaaacaaaatactcgtcaacataatcggatgatggcaggtgctaagggtgttgggcgtttctcttgcgacagactaggtgagtttttaaatctatatgctagaaaaaatggcgaaaaatcctacatacttctgaaaatagattggaagatgtttgaagttgaagatgaaaataaagaaatacaaagtgtcatcctcgattataaagaattaacagaagaagatttagttaaaagaaaagttgagccattcaaacaaggagtaatcttagagataataaaattgcggagcaattgggtctatgagattagaaatgacaaaggtattattatagattggaatacagacaagcttgtaaacctaaaaaaataccttgaaaaattaattaatcccaatcaggcatttgaggaaaatgattttggcatttatttgaatgcacaagaatttatagttgaaaataataataaggaagattctcaaaaatttataggaaaaatagataataccatttttgagaaacttgattttaagacaacaagtatcgaaagtgaaataattgaccagtttctggatcatagcactcagcgtgggctgcgtcacgcggcaatattccgccgctctggcaaaatgacggaactgatcaaccgccaatatatattctaattgttgtattgtcatctatcaaatatgattaagttatagatttcttctatgcaaagatagaaattatcagtttgacaacaagcattttccgccttatctttgcagtacagaaaaaagaaaacgaatataaatcattaaaaacaaatagaatatgaaaactttagaatttatcaaattgaacgaatcgggagcaaacaacgtagtagcatctttgcaacaattactggcagacttccaagtatattacaccaacctccgcggtttccactggaatatcaaagggcatgacttcttcgtacttcacagccaattcgaaaagatgtatgatgacactgccgaaaaagtggacgaaatcgcagaacgtatcctgatgctgggcggtactcctgccaacaaattcagtgattatctgaaagtagccaatattaacgaagtggataaggtaagcaacggagaacaggcactggataacatactacagtctatcagttatctgatcggtgaagaacgcaagattctgtctatcgcttcacaagccggagatgaagtaaccgtttcgatgatgagcgattatctgaaagaacaggaaaagctggtttggatgttgacggcttataacagcaagtaaatacaaggtttaggttttaagtgaaaaacaggctgactcgtgattattcagaatcagcctgttccatgtttataaactcagattagaaataagtctcttcgtcactcacagactctctacagaaatatcttttgttagtcttatgtcatccgaagaggcaccaatcattatccggaaatctcctgtttccacaacacgtttcatattccggtcgataatggacaggtctttttcggtcaaagtgaaaaagatttccttctcctctcctcttttcaggaagaagcgttcaaaacactttaattgtctgagaggctgaactactgaagcatattcatccctcagataaagttgtgccacttcttcaccgtcatagcttcctgtatttttcactttgaatgaaacttcaaaatggcagggagatttacgtattacctgtaaatccgaatattcgaaagtggtataactcaacccatagccaaaagtgtataatggagaagcagcttgttcgacataatcatgattgcggggagcctttttattataatagacaggtatctgtccgacagaacgggggatggaaaccggcaatcgtccggcaggattataatctccaaacaaaacatcagctattgcataccctccttcctgccccggataagaagcggtcagcaatgcgtcggcatactcggatgcccagactttatccagcggacgaccttcaatatagacaacgatcagtggctttccggtagccttcaatgcaatcaataaatcttgttgttttcccagtaaagtcaaggtagccctgtcaaacccctcgccacattccatgtcactgatactcttttcgtcagcaattgctgcacccgtctcctgatagctcgtcttgaaatcacgtgcgctggatcctcctaccaccgctattatgacttccgaacggctagctgcttccaccgcttccgctatttcgttcactgtcgtatcacgaatagcacatccacgcacatactccaccttagaaggagacagtttggagatcactccgtctaacacggtttttatgttttcatcttcttgcggagctgtatagtctcccagcatattataacgattatccgcattaggtccgacaactgctactttttttatcttcttattcaaaggaagaatcgaattctcgttcttcagtaatacaatagatgattgcgccactttgcgtgccaatttgatgtggtccttgctacgcactatcttcgttgctgttttcggatttacataaggatgttcaaacaatcctatttcaaacttcatccgtaatacccggcatacggcagtatcaatcaccgcttcactgatttttccgaattgaacggcgtgagtaagattcataaacgcatcgccacctaaatcaatatctgctccggcagaaacggcctgcatagctgcctcttctatagtaggggcaacaaagtgactttcatggactccttcaatactatataaatccgaaacaacaaagccacggaatctccactcgttacgcagtaattgtgtcagcagataatgattggccgtacaggggacaccatctattgaattgtaggaggtcatcacagacagtgctcccgcatcgatcgcttcccgaaaaggaggaagaaagttttcgtgcagatctctggtccctaccgatgcgtagttaccgttttgtccaccttccggtactgcataagccagaaaatgcttcaatgtagcgatggtagcatattcacaggacaggtctccgctacctagccctaggatcatcgccgctcccagtcgtccactcaatacgggatcttcaccaaaggtttcttctacacgtgaccagcgaggatcacgagataaatccagtacaggaccataactgatatgtgctccctgtgaacgaatctctttagcaatcacattccctacttcttcaatcagtgtcggtgaccaagttgccgccatccctatgccggttggaaaaacggtcgttccaatcgccatatgtccgtgaggtgcttcttcagccaaaaataaaggaatacccaaacgggtattttcaatcacatatttctgcaatgcgttgccggctttggcagccagctcgggattgaggccattttccaatgtcttcttagtccaagggtccgcacgataagttgcccacagcatacctgcgttcttttctttcattagtcttttaaacttttcagaaggatgtacttcatcgtcctttatttcgtacatttcccagccaagaggacataatagttgcccgaccttgtcttccaatgtcatacgtgaaagcaagtctttcacccgttcatcaacagacaagaccggatttttataaggtaacagagaagattgggcaaaagccacgacattcatcgccaatcctacaatcaaaatatataatcgctttgtcaacatacaatatgatataatataaaaattactttccgctggtttcgcagaagttttcatgcggtgaaactttagtttcaagctgatgaaactttagtttcaaacaggagaaactctagtttcaagcctcagaaactaaatgttctgccaattgaaacaaaccaagatactatcaattcaaagaatccatcaagagatcacacaaagatataataacccctgtgttgcagataaattatctgcaacacatctgcaacaggtatctgcaacacaataagccactataaatcaccgaataaacaagcaggtggcagatattgcagataaaatcaaaaaatattctagagagaggctatcgacacccaatttccgctattcccaaagaatcactttcgtccaccatacgagtcgcttttaacttaagatagcgagcctcaaccggactaaagtacacattctgaagaatcggattattacggatgttcgagaattctccctgtgctacgacttgcatcgcctcttcggtaataccggcagacagttcgtatgatgagatcaatcctttactatattcactttgatcaggtaaatagtagaatgaatggattgtacgattttcaccaagatcaatcatgatttccttgcctgagattaaagcagcagtctgatcgtccttgtcactacatttctttgcttcttccgtatccactcccaaaattgtaaaagggaaacttttcagttctgaggttgccggtgtataattttccgttgcatcgggagcgtaataagccccgacctcattgatacacaaacatgcacgagcatccgtaaaccgtatacgcaattcttctgtttcgatcatttcaaagcgtaacaaacgtttgtatcctacggttgtagtttcttcgttgcatttaaccgacagccactgatcgccctccttatattctacaacaaaggatttaaccctttgtcccaaaggtacatactcctgaatcattacccgattcatcttcgtcggctgactaaaagtgaaagtcaaatcggcggtagtcactccgtcattggttgcccaataagtatcgtactttccgtccgttacggcacgaaccttaaattgtcctccacgctcgtcgaaagctgatacttttgcactgctcaataaattatctgccaactctttctgaactctctgatggaatgaaacagcattcaatgaatcggtcggatgaatcaaaccgttgcggtctacagggaagtttaataataaagtcgcattatgacctacactacgataatacaagtccgtcagttgatcgactgtttttaccttgtcgtcttcctctgggtgatagaaccatcccggacggatagaaacgtcacactcggcagcgacccattgatttccatcggcatgaccgtactgtaattcccgatacttgggatatcccggatatacctcgcctgcccgaaggaaagaccagttagtagctccggcaaatccattctcatttcctacccaacggcagcccggccctccgtctgagaaaatcacagcctgcggttgcagttcatcgatcatcttatatgcccgcgggtaatcatagtatgttttgcggtcgatcgtacgtgcgtctttcgctcctccgtaccaaccgtctcctccgttggctccgtcaaaccagatttcaaaaacatcaccataattagtgagcaattcatgcaactgcttatagaaataatctacatactccggcgttccataattggcttgatgcctgtcccacggagagagataaacggcaaatttgattccatacttcttacaggcatcggaaagttcgcgtacaatatcacctttaccgtctttgtaaggggtatttcgaatacagtattcggtaagctgtgtaggccacagacaaaagccgtcatgatgtttggcagtcaggattactcctttcataccggaattgacaaatgtctgcacccattgttcgcagtccagacgagcaggattgaacgttttcggatcagagtcgccataaccccattcacggtcattgaaggtattgagaccgaagtgtacaaaggcatatgtttccatcttctgccaatttacttgcttttcctgaggaacgggtaaaatagcttccggtgccgaaacactctgacatcctgttaaaagtagactgaatactactgtagaaatactggttgcgattggttttctcttcatggtgttcgattcatttatagttttatcttttcaggttattttatttgccggtgctaagataggaaatattatattactaatcaaccggattggtacatgttatcttcagcggtttcattaatgcccgcccgttgatcacaggatagacacgtgtttcggtcggaaagctgccggaatattgatattcaacgggcatcacaccttcttcacgggctttcacctgacggggactggtaaacttaagatctgtattaccacctataacgacaaacataagctgtatatcattatcggtatcgtttacgtatttcagtttcattgttttcgtaccgcctttgcctatggtaccgaatgccattacttcgaaattcatccaaagtccactaccgtactcatacggataattctctgataccggatgtttgcagggaatgacggtgccttttacccaaatacggttgtagttggcattgttattgctcaaaacaactacttctttactaaagaagcccggtcggtaggccggattgtaagtcactttcactttacctgtagtattcggtcggagcggttctttaggaaattcaaactgtacacaaccacagccgcttgttactccattgatagaaataactttttgactgacattcttaaactcaaattcatgtgaaaccagtccattttcttcctttatttctccaaaatcaaagacacgttcttcgaacaccagttcgtcagaaagagtctgtgcgtacgaggcaaccaaatacaaattaatgcaacaaatcaatataataaagcgcagcaccatactttttttcatttaaaacaaaagcctctcataataactcattagctattataagagactttcatcaatcccgtttattcattctgatacatatcaaactcagacaaaacaatcccatatccactactatacggcaataattcaagtttgacatatcgagcactcacagctccatagaaacgaatatattgcggcgttgcacgagagaaagtaacgtttccctgatactcataatcttcacctcctgtttcacttgtatagacagcggcactggacaaactataattacgggaataatactgtaatcgaattcctgttatgttttggtatacgccattcaaattaacaataacggtagaactggcatcctgagacggataagtccttgtatttccgtcgaacagagttgttccaacatctacaccattgttagtggcagtccacgcgcttctatcactaattaatgtgccttccacactcgttgctcccggaacacaattcgtaaaagaggtgctaacagcgagataagcagaggaatgagtttcactcaatgccgcattcgataccgatgttacttttagcggtaaaagataacttgtattgacaaactcgctccactttccatcctctatttcaatagtaactgaatcagaagaaagcatacttcccgcaggaatcacgagttcttttttatccaaggttacttttaccccgtcagggaaagaagaaaattcacctatggatgcacaattatcaatatccaaagtaaccgttatatctttagaggcaactttagtagagcgtacccctaccttaactatttccggtccactctctaaactagagccaatcggtgttctcaacacttcatagacaaatgtattttgaggatattctgttgaagtccaacggttcacattaatatatacataattttggttgcttccttcgatatcgtaactttcgtcatcacaagactgaagactaaataatccgactacaaccaacaatcctaagatatgcatatttattttcatagcaatcatttatttcgttactcgttacatctgttattatcatcactgtcccatgcaatagcactgctataattcagattatatgttaatccagctccttcatttatttcacgggcagtgttcgtccaatccatatcatagccatgtcctgttgcatctttaaagatgtgtccttcgccttcattcattttccagtatgcaaccaaaccttctgattgtgaatcaacgccacaaagattcatctgtagttcgcctgtactcaaagcacggttccagacacgaacttcagcaatacggccacgaaaatactgagatccgcgatatcccgtccacgacattcctagttcaaaacgctggaaatcgaccggtttaccatcaccatcgccttgtgcatctttcactccgtctacatacatagtcagtttactgccatcatatgtcaacgagatcatataccaacgatcagtgctaaaacgtgtactcgatacaatacttccacttggacttacccactgcaaggcattgatatctaatccattttctccaaatcgcagcatacttgagcgctgttcgtcagcagaagtgaaactacacagacgagctatacgatgccactcttgagaatagcatttgatctcataggtgaagttagacaattcctgtttcttatcatctgagaaaataaagttactataaagattcgtattgctgatattcaatgaggtgaaatgaataacacgagatatctgcaagaaaatagttttcgaaggttttaatatttcaagtccatccacttctaccatagtaactggaactacatatactcgcccttctgcaaagtcttcggtagaaataactttaactgtagcaggagtagaaaacgctttacctgcctgaatcacagcatcagcatcttcaagagtcacagcgccctccggaatcgcataatatttagtattatgttcattattatatgtctctaccagtgacctgtcaatggcaaacttcacatttacgtctttatctactttatcagtagtagaagcagtgacggcatacgaagaaggggtatcttctaccacaaacttggttacaggagtagtctctgtccctgtaataaaagccatattcttgttataatcaaacttatcaccttctgtacaacccagaatggataaacctaatataactcccaacaaagaatgtttaaatatatatgttttcatcatgattcttatttattcattgtttactcatttacagcaggattcattatctgaatagcctcccggaattcattataaggtatacccgatgaagaataataatttcttcctaagtagaatactccacaaccgcctttacggcctttcgacggttcccaacgtgcatagttcataagttgtcccccatcggcatagaatactccgaacgattcgcagtaaatcatcttctcgggtggaaagttactgggttgagtcaagaaccccacttgatcactataagcctgttgaacgatataatcacaataaggtatgatgtctgttggtggtgttccactaaagtagtcaacgataagcaacttatccggctgttcgccttcaggaccaaaatacttgccaagttcctttatcaatctgaccaaatcggaaccactccaaccttcccagtcaacgtctactccatcaagtcccggttccaacacttgattcacaatccattttgcatatgcagccatcgcttcatcgtccttattctggctaagatcataatcaaccccatcaacggtaaactggtgtctgtaatgagaagcatcggcatgcatgacaaaacgtgtacccaatttccgctggcagtattgcatatccgcatatgctatcggatgtgtctctgctgtcggtattcccatccaaagatttacaatatctatactgtcaggcagtcctaccatacgttcaccccacgacgcgggatctttatagccggtcacaccttcaatcggtgaccacgcttcgtaataagcataacttatctcatgatcgcttttcttgaaagcacgcagattctcaaaatactgctcgtcatatgttttcagtttctgaatttctaacgcttccacatcggtatcacaactatagaaaaagaatgttccgataaggaaagtcagtaaacctgttatttttgttttcatcgtaattagtgtttttagaattaaacaatgtccattctcctgttatcgggattttttgtcccaccagagtttagttccacccgtatcctgaccacccaaagccgatataccactggcaacgccgctagcattgttgatcttctcgtcgcgtgtataaggcagacggcggacttgtaactgggtatcaatcgtaccattactactgtttcttactacaggaataacttccggatagcctgtacgacgatattcactccagccttcgggaccgtcgggataattggcaatccacttctgtgtaatgatgcgttccaactgagcttcaaatccggcattatcatcccatgcaggagtaaccctgctgctgaaagtataattatcactacccacattgtctgcaaaagcacccggagtcgaagtatgatcagccaaataatcgtctacaccggcggcattattctcctcaaacgacatgcgtacaccttgctcatagaatgatttggccgttccacccatatcccagccacgtaatgcaccttcggcacgcaggaagaacgattcggcagccgtcatccatactaccggagtagaagcacggttaatattcagattagagattttattgccttgataattgctcatattgcttgttgtgataccaatacgtacgccatgatattcaccgtcatcggctgctgtaaaataagagctgattcgcgaatcattcagtccgttcaaataggctacgatggtagcacccggacgacagtcacccgaattgaagttataggcaatctcgtgcaacggatgatgatattccaatgaattatgcgaaagttcggcacgttccgctttactttcgataaagccgaacatgttttccatcgacttctttgcctgtgcttctgccagtgtgggattcgcatatgaaacacgtatagcaagacgcaaacgcagtgtgttggcgaacttcacccacttctctacgtcccccccatatacacagtcatagtcactcatcagcttagcatccacatttccgttcacataattgctcaatacttcgatagcattatccagttcttcaaaaaacttattataaaccaaatccaatgcgtcatataagctggaagagccatagtttacatatggaataggaccaaatgtatcagcaatacggtgcatgccttctacctttacgatggtagccaatgcgtcaacttccggcagttcctgttcagtggctattttgtgaatactttgccatggtgccataattccggtataggcataatcaaaagtggcattcacccattgttcctgaaagttatactgcccgttatgattggtagatcctaaggtagcggcaatatagcccgaataaaggtcatgcgataagttctgagcaatctgatagtcagagtcgagcttgtcgccatcatttatgattacaacccgacgcagcatttgcgaaaagaaagcacccgtcttcaagttgtctacttccatcatttcctcggtgacttcattcggatttacgttatcctcatagtcgatacacgaaatgttatttaatagcatcaaagatatcccgagaatggaaagtttgttccatgatagtattttatttaatatcatattatcattaatcatggtggatgtctttctataatattcataagcattttaatttaaaagtataacaaataataactattctaataataaaaatcacaagtcaattatatgcaaatgtaagttttcaaacttccattccctcagaatatttaatcagtctctttctcttggcacaaatatttactatattgtcgctataatacactttatcatcttgtaaaaacaaacatatgcactcccaatatctatctaacatactactggcacgtatttacacttcataaaaatactctaagaacaaaatactccattgtgacaatttgcatatataaaaaaagttatccttcactacaattcaacttttacataatatgtatctacttctagaataaggtgacaactattctgaatagtattctattttacaacatttcaaatttattactgcacttccgctaaatgtttttgtcgaaactcttttggcgtacattcatacttttcacggaacaccttgaagaaagttactttattcgagaatcctgaatcgaatacaatttcatcaatcgtctttttcgtcgtcagcaataaatcttttgctatatgcaaacgacattcctttatcaaatccgtcggactgtcctctcctatctcttccatcttccgatagagactccggggactgattgccagccgatcggcgatataacgcggcgttaaatccttgtttgttatattatcattgattatcttcaaaaccgattgtaggaacttcttcgactctttgtgcgttaactttccatccgacttttcaaaagaactgatcggcgaactgaaataatttttcaacacctctttccgttctatcacctgacagacagaaatacgaaggtactctgcactaaacggtttcgtgatatacatttccgcaccggcagaaagagcctccatctgttgttccatctcgtgccgtccggaaaccacaataataggaatatgcgccgtctctttcaccgatttgatccgcctggtcagttcaatgccacccattcccggcatcatgacatcacagataatcacattcggataaacctcattcatcacctgatccagccgttcgggatcttgcaaggttaccacattgaagtcagccgagaagatttctccaataaaccatagcatttcgatttcatcatcgacaaccaaaagcgtaggacgcatcttatcaaactcatactggggaagtttcagtatcgattgagtatctatcttagggatgtattccgctgtgagccgcttggtttccgccactccggtagtcagttccacgaccggcaaggttagtgtaaacatcacccatccgtcaggagtattttccactttcaacgtaccattcagcaactttgccatattataagagatggctagtcccagtccgttccgtgaaaagttcttttcatcctgattctcgaaattatccaaaatggcataccgattaaaaatatactgaaaatccttttccttgatggtacttccttcattcgctacacgaagagtcagcatgttttccccgctcgtatccacttcaatcttgatactttgtccgtcgggagtatatttaaaggcattagaaatcagattaataataattgtattcaggaatcctttgtccgagttccacatcacctgctcgggtatcttgctcaagaaagtgatgtttctggatttagccatttctacaaacgttttggctattcctttcacaatggaagacacattcaatgactcaatccgtacttccctgtttcccgtttcaatccgacggaattcgatcaattcatgaatcaggttgttgagacgctccgcattcgtctgaatcatctgtacgtagtctacgacaaatttactaagtcctttcgatgaaaggattcgtccgcaaggaccataaatcaaagtcagcggagtacaaaattcatgtgcgatattagtaaagaaacgaagtttggactcaaagacattcttttgatggcgtttctctatctcgttcagcaattcctgctttttacgtttggagcgcaggataaaggaacgtatcagtaaggctgccagtaaaagcagacagaaggcataaatcaaataagcccaccaggaagcataccacggatcgcctatacgaatgaccagggaatagacatcactctctttatcaaaaacactattgtaatatttcaccagtaaggtatattcgccgggagccatattcgtaaaagagactccgctttccgaaccattgtttacccattggtcactcaatcctttcagtttataaaaataggtacagttattaccattcagataatccacagaggcaaatgaaacagaaaagaaattctggtcatactgcaaattcaagacttcagtttcttttttccgggtgagaaattcgcccagattgtattgttcaccgaagatagacagcttatcaaaataaacaggaggcatataaagctgctccggacggccatccgcccggatagctacgactccattgattccgccaaagaacagagtaccagtccgggaatcccgaaaagcggcaccgtcactaaactctaccacttttaaaccatctccaaagccatacgaacgaaagacattccgtttcgtatcgaaattgattaatccgagattagtgctcaaccagaagttgtcggacgagtttctaagaattgcatgaatggtattattcaggaaaccattcttagcattgaagagctgataagaagtttccgaagtgtactttatcaatccgtagctcgttccaaaaagatagttattgctgctgtctttactgatggcgagaatattattcagggtcatgttttcgtatttatgagtagacaccggttccaggccgttcgtcgtttcgttataacggaacaccccatatcctttattaccaaacaacaagttggcttcattctctgcataaatagtaaagaaatagttcgatcccagttcaccgtcattgatgacgtaacgttgcgcatccacaatcaccggattgtccggtgttccggcaatacgagccttcaccactcccatgccgacactcgccagccacagttcggaatctgctgtttcgtaaatgccatggatgtatttaaaatcttcgttaccgatccgtatcggtatactcttaatacgtttttcccgatatgaataataagttaatccttcttcgtctcctatccaaagcaaattccggtggctcttggcaaaacaataaacggcattactactcaaagcactattagaggtagtcaacacctctgcccggcagtcggagatgtttttatcgaattcgtaatcatagattttaagaattccgtttcctttagttcccacccagaaagtacgttcatcatcaagatagatggcacgcacggggcgttctattttctcggtgtaattgctaagcaccattgatttgatagaataaagcgggttcgaataaagataaacgccctgcccgtcagtaccaatccagacaatatcctgaaaacggtctttcttgagacagaatacaccgctgttgataggtaacgactgaatttgataatgatccgtctccttctgtttctccaacaggagaataccatccatcaaaaagcccacaaaatagctgttatgataatgaacgatggacgaaattttgccacgttcctgtatttccttacccagattggcaataaattcattcttctgggtcggaatatggaaagcataaaaattaaattccttgtctatgtaataaagagattgctcgtcattgaaacaataaatcaaggaagtctgataaatcaggtttgttttctggggtaacagggtgatatctcccgatgcggcttcctgctgtatgtcataacagcggttgtatcctttcatgactacccacatccggttgttaccatcgataaagaagtttacgatatcggaaatcgggattcccgtgatattgattttcttgaagactccttcttttttatgataataatagatgcagttactatcctggataatgaacagattgccatgactatccttattcataaagaagagtttctgaaattcattatagtgagtgattgtattggttttccggttcaaacggttcaacccatagtaggtttgaatccagtaaatatcttcgcccgtatacacaatattgtcaatcagattaccagataagtaatcctccttgtcacgagtcttaaattcctcaatctcctgtccatcataaatattcagtccgtcgcaggtcccgatccacatcaatccacgctcatcctggcacagagatgtaatcgaactattagacatatactctttatctgcaacttgcttcaaattataagcataagcgttatgtatcaacagattaagaaaaaagaatagaataaaaaccgactgttttcccatagtgtattattcttagatttgctatatgacaaaggtaaacaaaaaaacattccgagcttttttttggccggaatataagtaaagctccgtgccagagtagttaatttcagcgacaagaggcgatttagcccctctattactagaagcacattccttttctccctattttcgtcgtagaaattattttcaaatctataaattcatttgttcatgaaaacacatttttcatttaaacacttgctatttcttggaggtgccgtgttgtacagcctgcaatcttctgccgttaagaatcctgtagactatgtcagcacactgataggcactcaatccaagtttgaactgtctaccggaaacacgtatccggctacggcattgccgtggggaatgaatttctggacaccgcagaccggtaaaatgggagacggttgggcgtacacgtatgatgccgacaaaatccggggattcaaacaaacacatcagcccagtccctggatgaacgactacgggcagttcgccatcatgcctatcacaggcggactggtattcgatcaagaccgacgtgccagttggttctctcacaaagcggaagttgccaaaccttattattataaggtatacctcgccgaccatgatgtaacaaccgagcttgctcctacggagcgtgccgtcatgttccgtttcacgtatccggagacaaagaatgcctacgtgattgtagacgctttcgacaaaggttcttatgtgaaagtgattccggaagaaaacaagattatcggctattcaaccaagaatagcggcggtgtgccggaaaacttcaaaaactatttcgtgattcaattcgacaaaccgttcacattcgtttccacagttttcgaaaacaacattcttccgaatgaaacagaagcaaaaggaaaccacacaggggccgtgatcggattcgccacgaaaaagggagaaatcgtacacgcacgtgttgcttcctcctttatcagccccgaacaggcggagttgaatctcaaagagcttggcaaaaacagtttcgaccaactggtagcgaacggaagagaaatctggaaccgtgaaatgagtaaaatagagatagaagacgataatatcgataatttacgcaccttctattcttgtttataccgttccatgctttttccacgcagtttctacgagatagatgctaagggacaagtcatgcattacagcccctacaacggcgaagtgcgtcccggttatatgtttaccgacaccggattctgggacacgttccgctgcctgttccctttcctcaacctgatgtatccgtcaatgaatcaaaagatgcaggagggactagtgaatacttacaaggaaagtggtttcctgccggaatgggccagtccgggacatcgggattgtatggtaggcaacaactcggcttccgtagtagccgacgcttacatcaaaggattgcgaggatatgatatcgaaactctttgggaagcattgaaacatggagcaaatgcacatcttcgcgggactgcttcaggtcgtctcggttacgaatcttacaaccaactgggatatgttgccaacaatatcggcataggacaaaacgttgcacgtacattggagtatgcttacaacgactgggcaatttatacactaggtaagaaacttggtaaaccggagaacgaaatcgacatttataagaaacacgcgctgaactacaaaaatgtctatcacccggaacgcaaactgatggttggcaaagataacaaaggcgtattcaatccgaatttcgatgcagtggactggagcggtgaattttgcgaagggaatagctggcactggagcttctgcgtattccacgacccgcaaggacttatcaacctgatgggaggcaagaaagaattcaacgcgatgatggattctgtttttgtcatctcgggtaaactgggaatggaaagccgcggcatgattcacgaaatgcgtgaaatgcaagtaatgaacatggggcaatatgcgcatggcaaccagcctattcaacacatggtatatctctacaactattcaagcgaaccctggaaagctcaatactggatacgtgagattatgaacaaactatataccgccggtcccgacggttattgcggtgacgaagacaacggacagacttccgcctggtatgtattctccgcactcggtttctatccggtttgcccgggaacagatgaatatatcataggaaccccgctctttaaatcagcgaagttacatttggagaacggaaagaccatcacgatcaaggcagataacaaccagcttgacaaccgctacatcaaggaaatgaaagtaaacgggaaatcacaaacccgtaatttccttacacatgaccagctgattaaaggtgctaatattcaatttcaaatgagccccgtgcccaataaacaacggggaaccacagaaaaagatgtaccttactctctttcgtttgaataaaatattgtacttttggagatcaatgaattatctaccaaacaaactataaaaacatgaaactgaaaaaccttttactaattgcccttgttgcgatcgtcttttgcggttgtcaaagtaactatcagcctacttctatcaccgttgcctcctacaatttgagaaacgccaacggtggcgattcaatcaacggaaacggttggggacaacgttacccggtcattgcccaaatagtgcaatatcacgatttcgatattttcggcacgcaggagtgctttattcatcaactgaaagatatgaaagaagcattacccggttatgattatatcggtgtaggtcgcgacgacggcaaagagaaaggtgaacattctgctattttctatcgcacagacaagtttgacgtgatagagaaaggtgatttttggttgtcggaaactcccgacgtgccgagcaaaggatgggatgccgtgttgccgcgtatttgcagttggggacacttcaaatgcaaagataccggcttcgaattccttttcttcaacctgcacatggaccatatcggcaagaaggcacgtgtggaaagtgcattcctcgtacaggacaagatgaaagaacttggcaaaggcaaagagcttccggccatcctgacgggagacttcaatgtcgaccagacccaccagtcttatgatgcttttgtgagcaaaggggtgttgtgcgactcttacgagaaggccggcttccgctatgctatcaacggcacgttcaacgacttcgacccgaacagctttacggaaagccgtatcgaccatatattcgtttctccgtctttccaagtgaaaagatatggtgtgctgactgatacttaccgcagcatcgtaggcaagggagaaaagaagcaggcgaacgattgcccggaagaaatcgacatcaagacttatcaggcgcgcactccttcagaccatttccccgtaaaggtggaactggagttcgaccagcgtcagcagaaataatctttgtatctagttataacctgaaagtttcaccacacaacccgatattcctatgagaaatatatgttttgtagcctgtatgttattttgccttacttccgcagtgggaaagacaccgggaaatacccgttatctttctattgccgactcgattctatctaatgtattgaatctctatcagacgaatgacggactactaacagaaacgtatcctgtcaatcccgaccaaaaaattacttatctggcgggcggaacgcagcagaacggaacgctgaaggcttcttttctatggccgtattccgggatgatgtcgggttgtgtggctttatacaaagcgaccggaaacaagaagtacaaaaagattctcgagaaaagaattctaccgggaatggagcagtattgggataacagtcgcttgccggcctgttatcagtcataccccaccaagtacgggcagcacggacgttattatgacgataacatctggattgcactggattactgcgattattaccaactgactcacaagcctgcatctttggaaaaagccgttgcattgtatcaatatatctacagtggatggagcgatgagataggcggtggcatcttttggtgtgaacagcagaaggaagcgaagcatacttgttccaatgcaccgtctactgtgctcggtgtcaagttgtaccggctgacgaaggatgccaaatacctcgaaaaagcaaaagagacgtatgcctggacgaaaaagcatctgtgcgaccctaccgaccatctttactgggataacatcaacctgaaagggaaagtttccaaagagaagtacgcctacaacagtggacagatgattcaggcgggtgtattgctctatgaggaaacgggagatgaacagtatttgcgcgatgcacagcagacagccgcaggaactgatgcttttttccgcacaaaagccgacaagaaagacccgactgtcaaagtgcataaagacatggcctggtttaacgtgatcttattcagaggactgaaagctctgtataagattgacaagaatccggcgtatgtcaatgcgatggtggaaaatgcgcttcacgcctgggaaaactaccgggatgaaaacggattattaggcagggattggtcgggacataacaaggagcagtataaatggctgctcgacaatgcctgtcttattgaattctttgcagagatttaacacttcttctccgcaacactttcataatcaatactaatcaacaaaaaaagactattaccatgaatataactaaagccttttgtttgtccatagcactcttgggcgctagcaatatgcaggctataacgaacagtgattttgtcatccaacaagataataccaaaatcaacaactatcagacgaaccgtccggaaacatcgaaacgtctgtttgtctcacaagctgtggaacaacagattgcgcatatcaagcaactgctgacgaatgcccgcttagcatggatgttcgaaaactgtttcccgaacacactggatactactgttcattttgacggtaaagacgatacgtttgtttatacaggtgacatccacgccatgtggttgcgcgattcgggtgcacaagtatggccttacgtgcaactcgccaacaaagacgcagaactgaaaaaaatgctcgctggcgttatcaaacgtcagttcaagtgtatcaatatcgacccgtatgccaatgctttcaacatgaattccgaaggcggcgaatggatgagtgaccttacggacatgaagcccgaactgcacgaacgcaaatgggaaatcgactcgctctgttatcctatccgtctcgcttatcattactggaagacgacgggagatgccagtatattctccgacgaatggcttacagccatcgccaaggttctgaaaacgtttaaggaacagcaacgaaaagaagatccgaaaggtccttatcgtttccaacgcaaaacggaacgtgcactcgatacgatgaccaatgacggctggggcaatcctgtaaagccggtcggactgattgcttctgctttccgtccttcggatgatgctacaactttccagtttctcgttccgtccaacttctttgctgtaacttcattgcgcaaagctgccgaaattctgaatacggtcaacaagaaacctgatttagctaaagaatgtactacactgtctaacgaagtggaaacagccctgaaaaagtatgcggtttacaatcatccgaaatatggcaaaatctatgctttcgaagtggacggtttcggcaatcaactgttaatggatgatgccaatgtgccgagtctcattgccctgccttatcttggggatgtgaaagtgaacgatcctatttatcagaatacccgtaagtttgtatggagcgaagataatccttacttcttcaaaggtactgccggcgaaggaattggcggtccgcacatcggatatgatatgatttggcccatgagtattatgatgaaagcattcaccagtcaaaacgacgcagaaatcaagacctgcatcaaaatgctgatggatacggatgccggaacagggttcatgcatgaatctttccacaagaacgacccgaaaaactttactcgttcctggtttgcatggcaaaatacgctgtttggagaactaatcctaaaactcgtgaatgaaggaaaggtagacttactgaatagtatccaatagcttactttcccaaagttcaagattgaagactttagtttcaagtactatttttctgatttattgaaaacgagtttggccaccctcttgtttatcctcttctgtttatttatgtccgcatctttttccaataatgcttgctacatggatgttatgattgaaatcatctccttgcgtttaagattggctatagcaagttcagacagagttcccctatggcctttccctagtcgtcaatacatgccaacaagacccggttggtctcgttggcgacatccaactgttgttgtagaaccaatgcgaaatcagaacttttcataccataaatgcaataataaaattgattcatctaaacacatttcaacattatctcactaaatattaaacagttaccaattattgcaagcgatcttaaagtgcttcttaaaacggagtccttgaaccgttattcctctcattatgaaataaaatgtgtactagtcaagttcgtacacgccttttccgtgctacaacaagaaagatcaaaagtgcctcttgtaagtcgtttataatataggataaaaccatccccgtcccaacgaactacgaggaagttttatacgtttccgaccatgggaaaagaacgttttatttatatgggcttatctgtattttctgatattgcacattatgaaatattattcaattaagtcaagtagtatatgaatttagatgaagttttaaattatcgtcgctctgtacgggtatatgataaagaaaaggaaatagatatagaaaaagtaaagcattgcctggaattggcaactttggctcccaatagttctgatatgcaactatgggagttttatcacatcacacagcctgaattgatggcaaaggtatcaagagcttgtcttgatcaaaaagcaacttccacagcttcgcagattgttgttttcgtcacacgtcgtgacttgtatcggaagcgggcgaaattcgttcttgatttcgagacaggaaatatacggcggaatagtcctatagacaggcaggagaaacgtattaaagacagaaaactgtactatgggatattgatgccgtttgtttatgcccgtttctgcggtatcttaggacttttcagagtactacttgctaatgttatcagcattttccgccctatgatgctcgaagtatctgaaggtgatgtgcgtgtggtagtacataaatcctgtgcgcttgctgctcaaacatttatgattgctatggcgaacgaaggatatgatacctgtcccttggaaggcttggatagccgacggctcaaaaggttgcttaagttgcctcatggtgctgaaataaatatggtagtttcttgtggaatccggaatggaaataaaggaatttggggagaacggtgcagggtaccgtttgaggaagtttatcgtaagatttgatggcacggacgcagtagtaaaaacgcctaaatatatatgtattcgaattcaaactgaatgggactgccgagcaggatttgcagcagattgatgaaaaaggctatctgattccttatcagacagccggacgtgaagtcgtgaaagtaggagtggagttcagtgcggagaaaaggaatattggacgatggttgctttaaccagataacaattaatattaaagtgaatcctattagataatcagatgtgcggagatatgcttggcatatctccgttttaattgacataatccgccggagtaaagggatgaatgatgcttaccgacgtgatttaatcgttttttaataaatgaaatttattttttcctgattatacaaatagtacaaaagaatcttcttgtctggtcttgttttttatattccgcaacatttcatcctttgtgtcatagtattagtcaccttcgaaacatttattgtttgtatccgacatggatggagtttggctagtccccaaatatgcggatatttgtgaagtgagatttcactatcaaaagtattggtcctttcggaccggccgcctgtgaaggtagctctattgtttgttttgtttgtgtttggtgcatcttttttcaagcgagaaagaagatgcactatttatatctatctaccctgactatcggatattgaatgaaaatttgcctatgaaacagataaagcatacatttgaagaaaaaaagaaaatgggcgggaaagcatcaatgtggaacttatggcacggctgtcacaaatggagtgaaggctgccgccactgctatgtatatcgtacggatggcaaatacggaaaagacagttcggtggtgacaaagacggaaaagttcggtttgcctttgcagaagaaaaagaatggagaatataagataccctcgggaaatctggtatatacctgttttacctctgattttctgattgaagatgtggatgaatggcgtgccgaagcatgggaaatgatgcggatacggcaggaccttcattttatgtttattacgaagcggatagacagactgcaacagtgcctgccaccggattggggagatggatacgacaatgtgacaatttgttgtacaatggagaatcaggacagagtcgattatcgcttacctatttataaagaaagtcctattaaacataaaattattatctgtgaaccccttcttagtcagattgatttcagaggagaattggaaggatgggtagagcaggtagtggcaggaggagagtccggtaaggaagcccgcgtttgcaattatgactgggtgttggacattcgccgtcaatgtgtggaagctcatgtcggtttctggttcaagcagacaggaagttatctgttgaaagacggacatgagtataaagtcgcccgacagttccagcactcacaggcgaggaaagcggaactgaattatactcccgaaaaataacgaaagaacaaacaggaataagggaatgcaaaggctgtcggacagctttcacatccctttattgagtacaaaatatggataatcacgtctctccttaaagagatagtgtgtaaattttaaaattatccatattaaatgaaacagataaagctgttatttcttttagcttccgcctccgtcacgggagcatttgcgcagagcaatgggctgacggatatgagtcagagccgttatgcaaagatggcaaataccggaattgatgccgtacactggacgaatggattctggggagagcgttttaatgtatttagcggaacttccttgcagagtatgtggaatacatggaacacgccggaagtttctcatggtttccgtaattttgagattgctgccggtgtatgcaagggagaacattgggggcctccgttccatgatggagatatgtacaagtggatggaaggagtcgcttctgtgtatgctgtcaataaagatccggaattggacaagttaatggacaactttattgcttgtgtcgtaaaagcccaacgtgcagatggttatatacatacgccggttgttatagaagaactgaataagggaatagacagccatacgctggctgattcccaacaacagacagtgattggtacgaaagtaggctccgaggacgaaaaaggtgcatttgccaatcggttgaattttgaaacgtataacttgggacacctgatgatggcaggtatcgttcaccaccgtgctaccggaaaaacgactctttttgatgctgccgtgaaagctacagatttcctttgtcacttctatgagacggcttctgccgagttggcacgcaatgctatttgcccttcacactatatgggagtggtggagatgtatcgtgctacaggaaatccccgttatctggaactttcaaaaaacctgattgacattcgcggtatggtagaaagtggtacggatgataatcaggaccgtatccctttccgtgaccaatatcgtgcaatgggacatgccgtacgtgccaattacctgtatgcaggtgtggcagatgtgtatgcggagacgggtgaacaacaactgatgaagaacctgactagtatctggaacgatattgtcacccgaaagatgtacgtgaccggagcttgcggtgctttgtatgacggcacctcaccggatggaacgtgctatgaaccggatagcattcagaaagtgcatcagagctatggtcgtccgtatcagttaccgaacagtacggcacataatgaaacctgtgccaacataggtaatatgctgttcaactggcgtatgctggaagtgacgggagatgccaagtatgcggagcttgtggagacttgcctttataatagtgtattgagtggcataagtctggatggaaagaagtatttctatacgaatcctcttcgtatcagtgccgatctgccttatacactccgttggccgaaagaacggacggaatatatcagttgtttctgttgtccgcccaatacattgcgtacgctttgtcaggcgcagaattatgcttatacattgagtccggaagggatttattgcaacctgtacggtgcaaatacattgactacaaactggaaggacaagggggaacttgctttggtgcaggaaacggactatccttgggaaggcaatgtacgtgtaacgttgaacaaagtgccccgtaaagcaggtgctttctccctcttcttccgtattccggaatggtgcgggaaagctgcgttgacagtgaacggtcaaccggtatccatgaatgccaaggcaaatacctatgcggaagtgaaccgtacatggaagaaaggagatgtggtagaactggtcatggatatgcctgtttgtctgctcgaagctcatccgttggcagaagaaatccgtaatcaggtggtagtgaaacgtggtccgttggtttactgcttggagagtatggacattgcaaatggagaaaagatcgataacatcttgattcctgccgacataaagctgattccgaagaaaacgacgattgaaggcagttcgatagtagccctggaagggaaagcgcgtctggcatcgtctgagtcttgggaaggcgtgctttatcgtccggttgtccaagcagagaaaactgtggatattcgtctgattccttattatgcatggggaaacagaggtaaaggagagatgacagtctggatgccgctagcaagataacccattgtaaaaaagaaaaatgaaaaagttattggtaacaactatatgcctgctgggtgcacatctgctgtcagcaggtgaaatctggatttcgccgcaggggaatgatctcaatgacggtacacgtccatctccgaaagcgacgttgacttctgctttgcgtcaggcacgcgaatggcgccggacagatgatgaacgggtgcggggaggaattacgatctgtatggaaggcggtacgtatgcactctatgaaccggtgtttattcgtccggaagacagcgggacggaggattctcccacggtgatccgcccggtagctgatgaaaaagtggtattgagtggcggcatccggatcggtggatggaagaagcagggaaaactctgggtagcggatgtgcccatgttcaacgggcggccactggatttccgtcagttatgggtgaatggtaagaaagctgtccgtgcccgtgacgtagaggattttgagaagatgaaccgcatttgcagtgtggacgagaagaatgagattctttatgttcctgcggttgccatacgcagactggtagacggaaaaggggctttgaaggccaaatatgcagagatggtattgcatcagatgtggtgtgtggccaatcttcgtattcgttctgtcgaactggctggagacagtgccgcaatacgttttcatcagccggagagccggattcagtttgagcatccctggccacgtccgatggtaacgacagatgggcataattctgctttttatctgacgaatgcccgtgaactactggatgtagcgggagaatggtatcacgacatagatgcccgtaaagtctattattatcctcgggaaggagagaagttgcaggatgccggcacggaagtgatagtgcctgccatagagacattgatacaagtaaaagggacgttcgaccgtcctgtttcacatatccgttttgagaaaatcacgttctctcatacgacttggatgcgtccgtctgagaaaggccatgttcctcttcaggcgggaatgtatctgacagacggttatcgtattgacccgaaaatggaacgggactatctgaatcatcccttggataatcaaggatggctgggacgtcctgccgcggctgtaagcgtggctgctgccaatcagatcgactttgagcgctgtcggttcgatcatttaggctcaaccgggctggattatgaagaagccgtgcagggcggtgtcgttcgtggctgtcttttccgtgatattgcggggaacggactggtggtcggcagtttctctccggctgcccatgaaacacatttaccttatgaccctaccgaccttcgggaagtatgcgcgcatcaacaaatcagtaattgctactttaccgaagtgggtaatgaagattggggatgtcttgcaatccttgcgggctatgtgaaagatattaatatagaacacaatgaaatctgcgaagttccttatagcggcatcagccttggctggggctggacgcagacagtgaactgtatgcgtaacaacagagtgcacgcgaatctgattcatcactatgcaaagcatatgtatgacgtagccggagtttatacactgggctcgcagccgaaaagttatgtaactgagaattgcgtacatagcatttataagccaggttatgtacacgatcccaatcattggttttatctctatacggacgaaggctcttcttttatcactgtacgcgataactggacggaaggggagaagtatctgcaaaatgcgaacggtcccggaaatgtatgggagaacaatggtccgcaggtagatacagtcattcgtgaacgtgcagggttggaagccgaatatagggacttgaagaaataagaaaaatgaaaaagaaatgcatgatacttttgggtgccttgtcattggcaagcagcacctttgcccaaacttggatatggtatccgggggactatgaaatctggttgggcaaccagatgaacaaccgacgtacggaacgtggtgctttttttcctcctttttggaaaacagacagtcattatgtagtcgtagagttcagcaaagtattgaatctttccgaaccagaagaagtgtttattgctgccgagggaacatataatgtgaagctggacgggaaacttcagttcggaatgcctgaaaccttgctgcttccggcaggaaaacatagcctaaatattaaagtatggaatcaggcaacgcctcccactatctatgtgaaaggaaagacggtaaactctgattcgtcctggcgggtaacttatgaagataaggaatggatcgatgaaagcggtaaggctagtgacacatctgccaccatctatatggatgccggatgctggaactttgacggtgccactcaacgtccttcccaattcagcctgatgcgtgaacctcagcaacctgtcgctaaaacagaacaaccggaaggaggcatactgtatgattttggaaaagaaactttcggatttatcacattaaagaacctttcgggcaagggaaagattgacctctattatggtgaaagtccggaagaagcgaaagacaaagcatattgcgaaacattggataaactcctgctggagccgggacagatcactgatctcgctatccgcagcacatctcctttgcatcattctgataatgaatatacgctggagaacagcaaagcattccgctatgtatacatcactcacgaaccggaagtacagattggtgaagtatctatgcaatatgaatatcttcccgaagaatatcgtggtaacttccgttgtaacgacgaggaactgaactgtatctgggaggtgggagcatacacgatgcatcttactacacgcgagttttttatagacggtatcaagcgcgaccgttgggtatggagtggcgatgccatccaaagttatctgatgaattattatctgttctttgacagtgagtccgtgaagcgtaccatctggttacttcgtggaaaagatccggtgaccagccatagtaacaccattatggattacactttctactggttcttaagcgtatatgattattatatgtatagcggtgaccggcatttcgtcaaccagctatatccacgtatgcaaacaatgatggattatgtattgggacgtacgaataagaatggtatggtggaaggaatgtccggcgactgggtatttgtggactgggcggatggctatttagacaaaaagggagaactttctttcgaacaggttttgttttgccggagtctggagacgatggcactttgtgcagatttagtcggagataaggacggacaacaaaaatatgagaagttagcttctgcgttaaaagcaaaattagagccgactttctggaataatcagaaacaggcatttgtgcacaattgtgtggatggacgtcagagtgatgccgtaacccgatacgctaatatgttctctgttttctttgattatctgaatgcggataagcagcaggccattaaacagtccgttctcctgaatgatgagattctgaaaataacaacgccttatatgcgtttttacgaactggaagccctttgtgctcttggtgagcaggagactgtaatgaaagaaatgaaagcttactggggtggaatgttgaaagcaggagcaacctctttttgggagaaatataatccggaggaaagcggaacacagcatcttgccatgtatggccgcccatacggaaagagcttgtgccacgcttggggagcaagtcctatttatctgctgggtaaatactatttgggagtcaaaccaacgaaagagggttataaagagtttgctgtcagtccggtattgggaggtttgaaatggatggaaggtaccgtacctactccgaacggagacattcatgtctacatggataataaaaccattaaagtgaaggccacggaaggaaaaggttatctgaccatccagagtcgccgtcagccaaaagccaatatgggaactgtggagaaggtttcggaaggtgtatggcgcctttggattgattctccggaagaaaggattgttacctatcgtttgtagtcagagattcagattgaaataaggcctccggttgtattgctatagcggcaataggccggaggtctttctatctgtgcattatcgcactctttttgtgcgtatatgcacaaaaagaatatatgctgataaatccaaatcactagtatataacgctttatgttttggcacaggatttgaagtattcttctgcaaacaacagaatataatgaaaacactaaagtatgcatggcgtttccttgtgcgctccaaatcatatacagtcattaatattgtcggcttgtcattaagtctggcgtgtacaatcatactggtacgttatattcatcaggagacacgagtaaatactcattgcatagatgctgaaaatgtatatataccgcttcgggatattgatgggaatgtatatgcaggtagtgtatcagatggatatagtggagcagatacagttttctattctccggaagctgtgaaggaaaaggcccgttttgtaactttcagcaatgataatgttgccataaatggaaagccgtataccgtacaattattagcggcagataccgctttctttcatttcttcacgtatcccctcagtggtacaccaatgaaagctcccaatgatgtacttgttacccgccagtttgccgagcgtgtatttggaaaggaaaatccaattggagaaaaactaagttattccggtggtcatcttctcactgtctgtggtgtattggatgaaccggcatgtaaatcctcgttaacatttgacatcgttttaaacctcgaactcaagaatggagaaagaggatggggaaagatgctggttgaacttatccgttttatgccgggagtggatgtagatgctattaacgctattagtaatatctaccgtcaagctgatggcggttaccgtatacgttatgattttattcctgtcagtgagctttattggaataagatattagcagcaaaagccgatgctccggaaatgtggcattacagcagtcgatttcatttatgggtactgtcctgtgtatgcctgttgcttcttttggccggcattctcaatttcgtcaatatctatttggtttttatgctaaagcgttccaaggagtatggcatcaggaaagtatttggcatgagaggtcgtacactttttcttcagttatggacagagaatgtcttgatggtactcatcgctttatttttcgcatggttctttatagagatgttttcaggatatgccaatcgtttgctggaaagcaacgttatgtatacagctttcgattggcagctctctttggcaatatttatattgttgccactgttgacaacgatttatccttatcttaaatacaattatttgcctccggtcgtgtctataagtacgattggtacttcacgtcagtcagtgaaaacacgcacccttttcttatttgtgcaatatagtatcactcttttactgatcatcttatcgttgtattttagtaatcatcttcatttcctgctgaatacacctccgggtttcagaaccgaaggaattttatatgctgatctgatgccaaagcttcctaaccaatggtgggaggatagtcaggaaatacaaaataagcggtggcatgacagagaagttatggaacagaagctgaatgaatgcccatatatcgaacactggtttgccggagatactggtcgcgaaggcattttatcggctggtagcatgtcaagtatgataaatgataagggaggaaagttaaatatggcaatgatgtgggtaacagtggatttctttaagttatatggattacatatagttgatggttcattgcccgatgaagtaaatggacatgccgattatctggtagctatgaacaaagcggcattaaaagcttttggttatacccgtcgggaagatgcattcgtcaaaggtgaaagttcactttggagttctatatctaatggtaaaatagtagaaggtggattgtcattgatgcctgtacaggctattattgcagattattactctggacatttgactgctggtaaaaagccgattatatatatgatatccagcgcaggaattaatgcccagtgtcaaatatcctgtgtgccgggaaaagaaaaacaattagttgattatcttaagaaatgcagggaagacatatataactctaatgaattcgattatcattggctgaaagatgatataaaagcgttgtatcaggacgaccgccgcattgcaaccgtcttcaccctttttgccactatctctatatttgtttccgctttgggattatttggtctttcgttatttgatatccgccagcgatatcgggaagtagccatccggaaagtgaatggtgcccggctcaggaatctttattccatcctgttccgcaaatatatatggattataggcggtgcaacattactcacgatgccattatcatactatctgatatacatatatacatcagattttgtggtcaaaactccggtaagcatttctatttttgtgatagctttgttggttgtcgtagctatttccgcaggtacattgttctggcaagtgaataaggcggcacgaattaatcctgcggagattataaagacggaataaatctgaatggatgtatgaaagaagcatggaggagttgacaaaccacttttaatgttgtatctttgtaagtgaaaaccggaagtaaattcgataacattgataatatagacgaaaaaatgagcaataataagtatcatctaactgctttggtacttccatataagaatcaggagctatttcatctttaaatgtattgcaagcactcacagtacctaataagacgaaaagtaaaaccgtagtttgtattttaaatctcatatttcttatttttaatataacaatcattcctattcataataaggattctgcaacaaatccggtgatttcacagtctctttataaggtattggataaaaatacatcgctttacggaaggtatgctgacgagtatcaatgattcttcctgtcttccgctcaccatttcttgtgatttcaaaaccatgcatcatcctattatctgtatcttcagcaatcatccaacgacgtacatcaaagaaacgatgtccttcaaacgctaaatccaaccgacgttccaaccgaatagcttctgtcatatcagcctgactcatattattttcaattccatatgttccatcctcgccaggctctatgccagcgcactcacgtatctttctcaatacaatatatgggctaatttcttgatctcctagtacatctttatgatcaggtccataatattcattagcagcttctgcataattcagcaaaatttcagtataacgcatcaatggtcgtgcttgcgaacctccataaagcatttgatttgccattgaaccaaatttcaagaatttatgtgtataataccctgtcggagtccctcgatagatagcgtcctgttgtgttcccacagatatattaatttcagtatcctgcatattactcttcattatgcatccatcataagtaacagtgaacatgaaacgagggtcacgtttgttagcaggattcgtagggtcataatctggactatccttagtcggtgtgccatctgccattgggaaaagttcagccaaatcatgataaacataccctccaataccatttcctcctgtactaggaggagcaaaccatcggtttgtatctatactagctcctgctttcttttcaaagattgtaccacaataaacctccgttcccacttttccataataatcagcaggtaacaactgtgcataatatccccatcccggataagcctcattattctcatcttcattacgaatgtacaaatcatactgcttcatctttatcacatcaagggcagcatctacagcaattttccaacgctccttatcataagtaggataccctaacaattcttttggaaaatcagcaggcgcaaaatcactaccgttgaataatttgctagcagcatacaaacgtacacgtgaaattaaggctttacaagctcctcgggttacacgtccaaatttgtttccacttctttcaactggcaatgtttctgcagctttattagcttcatccacaatatactcaacgcaatccgcataagagttacgctccttgattgcttcttctacagtttcataaacatcatcaccaattaaagccacaccaccataatgtcttaatagcattgcataataccaagcacgcaaaaagcgtgcttctgctttatactcttcctttgccacttcagccattcgggatccatctgcatatttaaaaaacacatttactcgacgaatatttcgatatgcaattctccaaacatcgtcctcagaaatagtaacaggattgactgttccagtagcgaacattacatctgtcgtaagcccggtactagctttatacgcagcttcatcacaactagtctgcaatcctccatgatcattatactgatctttataccgattatgttggatatcaaaaccaatatccacataaatctggtttaagaaatctgccgtataagtactatcagcgaatacggttgcctgatctaagtccgtggtttctgtctcacccagaaaatcatctgagcaagacgaaaaaagccacgcacctacaatagataggaataaataaaataagcttttcatatacatagaaatagcggttaataaatttaattgataaactctaaaaacggtaatattcattattattagttctttttaatatgtgtactattttattgttatttatctaatgacgatttaaaaatgatataccactaaaacaattacatgttttttattaataaatttacttgtatgcaggaaagctcagaacatattaaaaaagaaagtcatttctcccttttatgaagaaatgactttctaaatcaatttaccaagatgaatccgtcagtagctatcaatcatcttcatcatatatgctttcccaattgaaaatacgataaaaataaggacgacaaaagtcagcactacccggaaaatcaaaattatctccagcagtatcagcatcagtattagtagaaaatactaattcaccttctcgtgcaagttctagatgcaaatttactctaagcaaatttttataatactgattacctatcttatccacagaataagggacattaaacaaaattttttgatctgtaaaaggtccataaggcgtctcaccacgatatagataaacagaatgaccataagatacagcttgtcctatcatatagtagtaatctccttttttaaagatctgtggcatactacatacataattattttccattatagtagagcgagttctctcctctttcgtcggatacatcttttgccacataaagttaccacttaaatcacgtatgtaatactcccactcagaagttaaatcatgagtagtggtgcgagcaactaatggtctgttattctctgttacataaagataaatatgtccatcttcatctttccatatagtagaaccatagccaacatcatctgtattgaattcttcgtttttactaattcttttaagataagtactattacccggctgtccttccaaactgtaaacagctagacaggtaccagttcgagtcattttaccttcatgattatctatttccccccacaacatttgaagttctttaactccattattatcaaatatcgtagcaccacctatctgatagaaatgctcttcatctgtttcttccataatagtctcatctggagctatgtgtgtatacgcctgataataaccttctccatcaggatcattagtttgtatataatcaactaaccatcttaaatcatcatccgtttctccaagactaccaccaacagtcgtttggatcataatactattatgtgggaaattacaattacctcttgctcttgtttcagcatctacaactccaaaatagctatcattaaaagcccatagaacatttccatcagacaatgatgtagattgcacaccaattccaccattccatcctaatgtgcgagtaaatagcttatcatactttttgtctttataaacaaaaacctcaccactatgctgacctacattaggaattagctgtaattcccatgccgaatctatatttggaggagtagtcgttacatcactatccactatttcttcatatgcagtttgcgctgcgtcataatcgttgcatgcaactaacgccactgcaacgaaagttacatatagaagactatatatatttcttgttttcataagatttatcatttattatcagccactcaattattttcgttagcaatagccactggagacatcacctctttcatttcataccaatcattcgagttataattataacgataattcaacgtaaactctttcttctctggattataatatgatggggtatcctcaatatttaacactgtaattccactatttacattataccatttatctaatgtcactttttgacattggatatattctccagttggcaatccattactcccgataacaggaacatcaatcatctcctcaggatggaccgtaacaacaatcccttgtttacggagttcttttctatccgatgtaagtgtagatcccgttaaaatacgaataccatattccgtaactggagcaactaacttagtggcatttattggtttataatctggagcattattctttttgtccaaaggttcccaagtatctttagctactctcaatcttgttccattcatagtataatagcttttctccttagtcgttgcataatcatttttcataagtatctgcatcaatacattcctccttgcagaagaaatcatatagtcagaaacagaagctattcttaaaggaagaaagtaattatcttcaggttccagcccatcaatatttactttaattggaaataaagaataagatgaatttgcatttggatataaatttatactccaatcatctactttataatgagtatctggtaactccaggacatagtttttgtaattatccccatatctcttttgattatagtccgataatacagtttcattcctttccagttctaccatcacttctttttcaattggagttgtaccacttgcataaacagaaaggtatcctatttcctccccgccgaaagcaaattctcgttggaaaatattatcttctccactaacaatataaatttccttacgatactgttcatcctgataaaactcttgctcgcaggatgtgagaacagcagtagctgtcacacctaccataagcatcaatttatttgtaaaatttctatatttcatagtttatacatttaaaattttatttatcccaaccaggattctgatcaagaacagaaacctttctaatctcatccaaatgtaaaggtaaccataccatcttaggtttgaaatcacgttcaattattgatttatactgaatgacagtgggctgatagaatccttcccattcagcctgttctacatttaaccccattaaaggttccctttctaaatcttcaacaattccccagcgtctaatatcataataacgttgtccttcccaaaataactcaatcaaacgttcacgttgaacaactttattaaaagcttccactgtaatcaaatcatccgctgttaatcccggaataccagcacgataacgtatctgattaaaataatatttgatagcttctgtatcacgagtataagtctgaccatcaatttcatatgcttgagttaaattattcaaggcttctgcataagcaagcaatatttctgcatatcgaataatcggaaatgacttatctttttgacgcgccccactaccactcatagcatcttgtggattgatatattttcgagaagtatatccagttatattataaacattattattagaatgatttttaccagaattagctccattccaataatcaatattaacatttttcttagcactttcagtagtagatcccatcgcccaccaagcatgtgagtaaccaatattcacatagaaacgtggttcacgattagtatatgccaaatatgttccttggctgattttataaccttcagataaaactttgccttctgtcgtcacacaagtcttatcataaggacgggatatatacggatatgcactactagaatttttaatatcacgcccatctgccatataaaattggtctactatatgctgaggtacacataaacaagaagatcctccaaaattcaatgggaatacgtaacccatatggctaccaacctgcgctgtagaactacaccatatgaactccggattttgattaatagcaagctctccattaaacatttcggcataagagcgatacggatctacgacttttttatctcccatccctacaccatttggaaattctgcagtaggaacctcttgcggtagagtgactacatatgtaccataattccctgattcaggatgttcagcatcagtagaagcagcaacagtatataattgatatcgtcctaaatcaataaccttcttcgcagccgcagcagcaagtgcccacttacgttcatcatatgattgagaaacataatgatctccatctgtacaacgggtaaaatcaccaaaaaatctacgggctgcctctccaccgttatataatgggctagcagcttgtaatctcacacgagcagctaaagctaaggcagctccttctgtaggaatatattgatccatcgaagtggtagcatcaggtaagtttttagcagcttcatcaaattctgaacaaatataatccacacattcgtcatacgtattacgcgttcttgcataatactccgcttcctcattattactaacaatttcatcacctaacaaaatcattggaccattctgttgcaaaattaaataatatgcataagctcttaagaaacggcattttgcacgaaattccattctttcaaaactattcatatcacgaacaccatcaatatgtggcaatatagtattcaccttacgaatcaccttataacatttaggccaaatattgaaatcccatgtccaaccgcccattgaactagaagtaatctcattattcattaacttcgttccagagaattgtataacaaccataccattccaatcaccacagctcacagcctcgtctgaacctgtaactccaggagtgttcccatattcccaaattttatcgacaacaggaagcagagcggcagccccattaaaataacgttcaatattacgcttatttgcataaatagaatcttcttgaaaggtatcctcaaaataatcatctatattcaaataattacaagaagcaaaaaagccggataccaataacagaaccgataatataaaatattttttcatgaactaatttctattaagtttatacatcgtattagaaattcaaatatagctgcaatgaataacgtgcaggtaaaggataagcctgtccacaagatgtcgcttgttctggatcgaatatatttacagaatcccatactgccaaattttcacacatcaactgaatattcatggaattaatgcccaaaatacgttgtaatgcaggaacttttagattatatgccaagctcaattcctgtaaacgcaagtaacgggcatcacccatccaaaatgtagaaggtttcgtattattctcattttttccataatacaaacgtggaaaacgagcatttggattctctgtagcctgatttcctgaatattcagcagaaatccaacgattctccggattataagcaattgtcattatatttcctttatccttctgattaaatggcatgtatccatcgaagtttctaccatccgaaccgccatataagaacttattacgtcctgtccctttgaacaagacatttagtgtccaacttttataacgaaactcagcaccaataccatacatcaactgtggtacccctgaataagcaaataaaggaactttatcatcatcagtaattttaccatcaccatttatatctcgatatttaatatcaccaggacgtaccgtaccaaattgtgtaggactcatttctacatcttgttgatctttaaacaatcccatagcaacaaatccacgttgtacattattggcataaccattattttccaaatatgtataaggcttctttgtatcttcccaatttaatatcttattcttactcaaagtaaaattactacgtaatatcacatgtgcatcctttcctatctgttgatagaattccatatttccatcagcaccccagcttttcatacgacctatattaccataaggcatttgaatcaaacctacataatcaggaatttgtttacgttcctgaaaaataccatctcgtgtatccttaaaataatctaaagtcaaagtaaatttatctttaaacaaatgcagatccataccaacatcaaatttctttgctttttcccacatcaaattattggcaccaacttgttcttctgttaagctaccagtccctccccaaggatttgaagcattttcttcttttattagggtcagataaggaaaacgtctagaactgatgcggtcattaccaacaacaccataagaaacgcgaagcttgagaaaattcaaccaacttacattttcacgtataaattcatatgaagatggtacccatgcgaaagctcctgccggaaagaatccatattgtttacctggttcaaagttttcagatccattcaaaccaaagttcaaatcccaaaaatatgtatctttaaaaccatatgtaaaacggcccgaaagactttgataacgctttggtatagcattcatacttttatctgcaccagtttcagatgtatcttctatataataaaacagtaaaccacctaaacgatgatcgccaaaggtacggtcataattaacatttgcctctaaatatagcttcctccaaacccaagcagcactgctatatgtaacggttttctcatcagctattttctcaaaactcaaggttccattagggttacgctccttcaaagcttcatttagttctggcattttatagcgtgcttctccaaataaactttgtgtatcccatgatccctgtactttagctgatagccctttagtaatcatcgacaaatcctgtgtaatacctaaagtaactaaattcctggtattctgttctctagcattacctgtataattcaatagaacatacggagatatttcatccttagttcctgcagcaggataatatccgtttgaatagcgtaatggatagcttattggagtagtctttgcctgtgaactccatagccaatctgtcaaactgactcctctagaatattcccccatgctcgggcgagtattcaccgacatatagccagttgttccaatatagactttagttgttttagtcaaatctatatccaaattcaaacgataattataagtatcatagcctacacctttattgtatttactatctttggatggattataagccgcagattctttcgacattcctaaacttgcaaaataacgggcaacactgctaccaccttgagcacttacataataagtttgctggaaagaattgggatttaaaataacatcttgccagtcaatgtttgggtacagatccggatctaagccatattttataatatccatttctgtcttgttataaataggagataatccggttgcaacagaagcttcatttgccatttcagcatattgagtggcattaacatattcaggtaaacgttttaaatgtgagattgtcatattagcacgaccactgatcttcaatttggactccaaaccacgcttcgtcgttaccaatactacaccatttgcacctcgactaccatacaccgctgtagccgcagcatctttcaaaacagaaaaactttcaacatcggcagcatctatctgactcaaactaccttccaaaccatcaatcaacactaatgcaccactattagcaccaaacgtaccaattccgcgcacccaaaactcggaaatatttttgcccggttcaccactagattgaactccaatcacacctgcaacacgacctgctagtgtattaactatatttgtagcaggaacctctagttgcgctggatccatcgttgtaattgcaccagcaacactgacctttcgctgcgtacccatacctactacaactacttcatcaatattctccgtagccggttttaaggtaactttaacattgtcaattttattcgtcaaacgttgctcatagttttcatatcccaaaaaagacacaaccactatatcatatatatttacctttaaccgaaatttaccatcaatattagttgttattcccacacctggtttatctttaacatatacatttgctcccggaactggttcattaaattcatcgaagactgtaccagtcaacataaagctttgctctttctgtgcatgtacttgtgctacaaacgcaagaagcaaagcaaaaattacaaatattcgattcatattatattaaatataaagtttcactaattatttattcgacagctaatcgacgaatagcacgattctctgagtcgccgatatacattacatcgtcgttatcaatacaaattcccaatggctttttgaattgagcatcttctgcactaccatttacataacctgaattttggggttttcctgctaatgtagatacataacctgtactcattgttatcttacgaatacagtgattttcggtatcagtcaaaattatattaccttctgaatcgacacacatctgtccaggtttattaaacatagcttgtcctattggtccatccaaatatccacttttaccttcttgaccagcccaacatgcacattctttagtacgtaaatcatatttataaatacaatgcttatcattatttgagaaataaaaaacattctcatcttgaggatcgaaaacaagtccataagcactaccatccttggttccaaccaaatccccattcgttagattctctcctctagcattctctacatcaatccgtaccagatttccacctaacattcttgaatacatttttccatctggtcccattgtaaaattacacttggctgcccatactccaaatccttcaatatttggaaaatttggatcatcccatgaaatagaacttatagctgtagttggtgcataatccgtcttagggtcaaaataataaacttcatgactatctctattagcccagaattgatagacaatatcatccttactgttataccccaaaacaggagagttaaacaacgcattaatatctgactttagagatattaatttatcagcctcctcatttaacataaatgcagcaaactttccatcattatctactaaaaagaaaacatttttatcctgatctacacaaatacacctatcaatatttgctctaaattgtgcttcagatagtggtatagttcctgttggattcacctgtgccgatgtacttcctcccactaacgtagtcacagtagtctggatataataatcaaatgtctgcttgtactcctctatttgttcatgtacttgtactttaaccacacattctgggtcctctattgtagatgcacgtttaggagccaataccaacattctatcatccttcacagaaatgacagaagcctctttatcattgaaaaagaccttcacattttccttactatccccaaaattcgatccattaagaataacttgagttgcaagttttccttcgggcggataaaaatcagtcaacacaatcggcttattcggatcatagcccgaagttgactcttcatcatctttacaagacgaaaagcagcagcctacagccaagcagacaagccactgccatttaaaacatttttgtaataagtttctcatagaaaataccgtttttaagaatttatataataataatgatcataattttactttcgttattttatgtttctttctcatactttttgctactattaatagtaagacgactagactaatactaaccactaagtaagtcgaggtaaaaactacgaatgataataactctcttctcataatattcctaatttggtgcaaatctacattattttgtttagaaaacataggaatctttcaaaattgcattttttaataaaattgtagaggggaaagtctgcattcttccccttttttttataattttgcgctttttaagttcgtaagaaactactaagtaaaaataattaaaacagttatagctgtgggagaaacaaagtatattttcgtcaccggtggtgttgcctcttctttaggaaaagggatcatctcatcctccatcggtaaattgctgcaagcaagaggttacaatgtaaccatccagaagtttgacccgtatatcaacatcgacccgggaacattgaatccttatgagcatggagaatgctatgtgaccgtagacggccatgaagccgatcttgacctgggacactacgaacgtttcctgggtattcagactacaaaggctaacaacatcactacgggacgtatctacaaaagtgttattgacaaagaacgtcgcggagactatctgggtaagacgattcaggtgattcctcatatcacggatgaaatcaaacggaacgtaaaattgctcggtaacaaatacaagttcgattttgtaattaccgaaatcggtggtacggtaggtgatatcgaatcactcccctacctcgaaagtatccgccagttgaaatgggagttgggtaagaacgctctttgcgtacacctgacatatgtgccttatcttgccgctgccggagagctgaaaaccaaaccgacacagcattctgtcaaggaactccagagcgtaggtattcagccggacgtattggtgcttcgtgccgaacacccgctgagcgacggactccgcaaaaaagtagctcaattctgtaatgtggatgacaaggctgtcgtgcagtctatcgacgcagaaacaatttatgaagtacctctcctgatgcaggcacagggactggacagcacaatccttgaaaagatggggctgcccgtaggagaaactccgggactaggtccgtggcgtaaattcctggaacgccgtcatgctgctgaaacgaaagaacccatcaacatcgcattggtaggtaaatatgacttgcaggatgcttacaagtcaatccgtgaagcattgtcacaggcaggtacttacaacgaccgcaaagtggaggttcactttgtgaacagcgaaaaactgacagatgagaacgtagccgaagccttgaaaggcatggcaggcgtgatgatcggtccgggattcggtcagcgtggtatcgacggtaagttcgttgccatcaaatatacacgtacacatgatataccgaccttcggtatctgtctgggtatgcaatgtatcgctatcgaatttgcccgcaacgtattgggatatgccgatgccgactcacgcgaaatggatgaaaagactccgcacaacgtgatcgacatcatggaggaacagaaagcgatcaccaatatgggaggtacgatgcgtctgggcgcttacgaatgtgtgcttcagaaaggatcgaaagcataccttgcttatggtgaagaacatattcaagaacgtcaccgccatcgctatgagttcaacaatgactataaggctcaatacgaagctgccggtatgaaatgcgtgggtatcaaccccgaatcggatctggtggaaatcgttgagatcccggcattgaagtggtttatcggcactcagttccatccggaatacagcagtacggtattgaacccgcatccgttgtttgtggctttcgtgaaggcagccatcgagaacgagaagaattgacaattgacagttgacaattgacaatttattattcaaaaatttataattcataattaataggaatggataaaaacaccattacaggtctcgttttaataggtatattattggtaggattcagttatctgagccgtccaagcgaggagcagatagctgcgcagaagaaatactacgattctattgccgtggtgcaacagcagcaggaagcgctgaaagcaaaaacagaagccgcactcgccaatgaaaacaaaggtgcagcggcggcagcagattcttctgccctgtttttcaacgcgatgcatggaactgattccaaagtaagcatccagaacagcgtagcggaaatcactttcactacgaaaggcggacgggtatattcggctatgctgaaagaatacaaaggacaggacaagacaaaccctgtcgtactgttcgacggtgatgatgctaccatgagtttcaacttctacaacaagcaaggagccatccagacaaaggactattacttcgaagctgtcaataagacagacagcagcgtaactatgcgtctggctgcggacaacgccagctacatcgattttatctatacgctgaaaccgaacagctacctgatgaactttgaaatcaaagcaacaggcatggaaggcaaactggccagtacggagtatgtagacatcgactggacacagcgtgcacgccagctggaaaagggattcacttacgaaaaccgcctctcagagctgacttataaggtaaaaggtgacaatgtagataatctgtcggctgccaaggatgacgaaaaggatctgggcaatacagcgatagactgggtagcattcaaaaaccagttcttctcttctgtattcattgcagaccaggacttcaacaaggtttctgtgaagtcaagaatggaacaacaaggaagcggatatatcaaggattattctgcagaaatgagtaccttcttcgatccgagcggaaaacaaccgacagaaatgtacttctactttggcccgaaccacttcaagaccttgaaggcactggacaaaggacgtacagagaaatgggaacttaacagactggtatatctgggctggccgttaatccgctggatcaaccagtttatcacgatcaacgtattcgactggctgtcgggctggggcttgagcatgggtatcgtactgttgattctgacaattatggtgaaggtggtagtttaccctgctacctggaaaacatacatgtcttctgccaagatgcgtgtattgaaaccgaaaatcgacgagatcaacaagaagtatccgaagcaggaagatgcgatgaagaaacagcaggaggtgatgagcctttacagccagtatggcgtgagcccgatgggcggttgtctgccaatgttattgcagttcccgatcttgatggcattgttcatgttcgtaccgagcgctatcgagttacgtcagcagagcttcttgtgggcggacgacttgtccacttacgacgcgttcatcacattcccgttccatatcccgttcctgggcaaccatctcagcttgttctgcttgctgatgacggtaaccaacatcctgaacacaaagtatacaatgacgatgcaggatacaggagcacaaccgcaaatggctgcgatgaaatggatgatgtatctgatgccgattatgttcctgttcgtactgaacgactatccttcgggattgaactattattatttcgtgtcaacactgattagtgtaggaaccatgattttgttgcgtaaaactacagacgaaacaaaattactggctattctggaagctaagaaaaaagacccgaaacaaatgaaaaagaccggatttgctgcacgcctggaagctatgcaaaagcaacaggaacagttacagcagcaaaaacagaataaacgataagaaattatccgaagatatattctgagaaagccgggcaaccgaaaggggtttgtccggctttctttctctaaaaaacaaacttaatatgaagacaaaatatacttataaacaaatctggacgatcgcctaccctattctgatcagcctgattatggagcagctgatcggcatgacggacacggcctttcttggacgtgtcggggaaattgaattaggggcatccgccatcgccggggtttactacctggctattttcatgatggcattcggattcagcgtaggagcacagatattgatcgcccgtcgcaacggggaaggaaactacaaggaaatcggaccgattttctatcaggggatttatttcctggtagtggttgctgcgattctgtttacactttccatcgtattctcgccatttattttaaagaatatcatttcgtcccctcacatttatgatgcagcggaaagttatattcattggcgggtgtacgggttctttttctcatttgtcggagtgatgttccgtgccttctttgtcggtacgacacagaccaagacgctgacgctgaactccatcgtgatggtgctttctaacgtggtattcaactatatcctgattttcggtaagttcggtttcccacaactgggcattgccggtgcagccatcggttcatccctcgctgagctggtatcggtgattttctttatcatctatacctggaagcggatcgactgcaagaagtatgcactgaatatcctgccgaaattccaaagccggacattgaagcggattctcaatgtctccgtgtggacaatgattcagaacttcgtttctttatctacctggtttatgttcttcctgttcgtggaacacctgggagaacggtcattggctatcgcgaacattatccgaaatgtgtcgggcatcccgtttatgatcgccatggcttttgctgcaacctgcggatctctggtcagcaaccttatcggtgcgggcgaaaaagattgtgtacggggaaccatcaatcagcacatccgtatcggatatgtgttcgtactgccgatattgatattcttctgtctgtttcccgacctgattctgcgcatatacacggatatgcccgatttgagggatgcgtccatcccttctttatgggtgttatgcgcagcctacgtagtgctggtaccagccaatgtgtatttccagtcggtatcgggaacaggtaacacacgcacggcactggccatggaactttgtgtactgacaatttatgtagcttacgctacttattttattctttaccttaaaatggacattgcgtttgcctggacaacagaaagtgtgtatggaatctttatcttcctcttctgctactggtatatgaagaaaggaaactggcagaaaaagcagatttaaatccttttttcattatcttcgcaagaaaataaacatttttataaaatatgagacaagcaaatctatttatgatgtcggcagcaatgttgttagctgcctgcggcggaacaaaagacgcgggcaaaacggatcaggtgcttatcgaaaaatccgatattaagatcgaagggaagcgtatgacgcctgaagccctttgggcaatgggacgtatcggaggactggcggtatcgcccgacggaaagaaaattgcgtatacggtagcatactacagtgtaccggagaacaagagtaatcgcgaagttttcgtcatgaacgcggacggcagcgataaccgacaaatcacccgcactccttatcaggagaatgaggtgacctggataaaaggaggatcgaagctggctttcctgagcaacgacaacggaagcagccaactatatgaaatgaatccggacggtagcggccgtaaacaactgaccaactacgatggtgacatcgagggttattctatctcaccggacggcaagaaactgctgttcatctcgcaagtgaaaaccaaagaaagcactgccgataaatatccggatctgccgaaagctacaggtattattgtcaccgacctgatgtataagcactgggatgaatgggtgacaactgctccgcatcctttcgtggcagactttgacggtaacggtatttccaatatcgtggatatactggaaggagaaccatacgaaagtccgatgaaaccttggggcggcattgagcagctggcttggaatacgacttcggacaaagtggcttatacctgtcgcaagaaaacagggctggaatatgctgtttctaccaattcggatatttatgtgtatgatctgaatacaaagaaaacggataatatcaccgaagaaaacaaggggtatgacaccaatccgcaatactctccggatggcaagtacattgcatggcaaagcatggagcgcgatggatacgaagctgatctgaaccgtttgtttatcatgaatctggaaactggagagaagcgttttgtcagcaaagcatttgagtctaatgtggatgcgtttgtctggggcaacgatgccaagaccatctattttacaggtgtatggcatggagaaactcagatttattctcttgacctgacgaatgattctgtaaaggcgattacttcgggtatgtatgattatgaaggggtagcactcttcggtgacaaactgattgccaaacgccactcaatgagtatgggtgatgagatctatgcggtagcattggatggttctgccactcaactgacacaggagaacaaggagatttatgatcagctggaaatgggtaaggtagaaggtcgctggatgaaaacgacggatggcaaggatatgttgacatgggtgatctatcctccccagttcgatccgaacaagaaatatccgacattgctgttctgtgaaggtggtcctcaaagtccggtaagtcagttctggtcttatcgctggaacttccagattatggctgccaacgactatatcattgtagccccgaaccgtcgcggattaccgggattcggagtggaatggaacgaacagatcagtggtgattatggtggtcagtgtatgaaagactatttcactgctatcgacgagatggcaaaagaatcgtatgtagataaagatcgtctgggatgtgtgggcgctagtttcggaggattctccgtatattggttagccggtcatcacgacaaacgtttcaaggcatttatcgctcatgacggaatcttcaatatggaaatgcagtatctggaaacagaagagaaatggtttgccaactgggatatgggcggcgcgtactgggaaaaacagaatccgatagcacaacgtactttcgccaactcccctcacctcttcgtggaaaaatgggatactccgattctctgtattcatggagaaaaagatttccgtattttggctaatcaggctatggctgcatttgatgccgctgtaatgcgtggtgtacctgcagagttgctaatttatccggatgagaaccactgggtactgaaaccgcagaatggtgtcttgtggcaacgcactttctttgagtggctggataagtggctgaaggctcctgcaaaataaatctttgatataagacaaataatgaaggctctgttctcaaatcaaattgagttcagagccttctgcattacatctaaaatccgctagactttactcatgatatatattttcgattgctactatatacttagataaggtctatgattcaatctagacctgtttcataatccttttcaaatagctcaatcggagcctccattaaaacagttttttcagcacctttttcgtctgataaatcaattaatcccattttttgctcccttaattgttctccagtccatctgccttttaaatggtattcttcccctttatttacggccttcagtaccaaataaaaagttaaggtacatcgatatccacattcttgttttgttaactcataagttgaatagggaggtatcttatactttacatttccaatagaacgtgatccattctttacttttaatgtttctccaaaaatcaacggagtcttcgcacccgttccgtctataaaaagcttacctccagcatcaatgaaaggaacaggaatcttcaaatccgccaaattttcagcattaacaggcaaagaaccttcagtcaatacaaataaagagttctcttcctcttccacatcccatgcatatatcattggaagaggttcatctttatcatttactttatgttgcaagactactacaggatattcaacccgctctactacatccgtttcctcctgcacaaacttataggaaacaacctctaatatcgccggagtattggatggagaagaagacacatcatccgaatcactactacaagctgcgagtgcagcacagatacctgcaagaaagaacatttttgttttcataacgcttagttttagttgtgttacaatagtttagtttagggcaaatgtataatatttatatcacttatcaaagctttaccgataaaaaataaaaaaagggagaattaatctccctcccaaatattttcgatttctactatatacattttatgaaaacctccatgagcatcgtcataccatttttccaaggactctttatccaggaaacattcaggtttaatgttatccgcatacagttttcttccttccagactcaggcgggcctgttcgaaaagcacattcccctgttctgtgaagaccggcttcaatccggttgctttcaccttatccgtatcacgaccggactttgagccacaaactgcatgaatcttcttatttgcttcgcccaaaaaagaaagtgtcagataatcacttttctcgatgaactcatacgtatatcgttcggggcggacaaaaacaaaagcaacgggcttattccaaagccagccaatgccaccccagctggcagtcattgtattgaatttctctttggtgccggcagtaaccaacatccattctttgccaatcgcctcaaagaaattttctttcaggtcttttacttctaacttcttcatctctcagtttattttataattactttcttttactcagttttacgatttctcccagataagggatttctacacgaatctttcttttctttgcttctgccgcaaatactttaggcggatcatgcaagggttcatcagacaaatcaaatgtaccgtagtgcatcggaatggttattcctgcgtgcatctcttcggaggcagtcagtgattcataaggagaaatatgattgggacgcatgaaccaacggggtttatatgcaccgatacccaacaaggcatagtccggagctccgaacagatccgggatttccctaaaatgggtagaataccctgtgtctccgctataatagagagaaacaccattcccctgcagcatgaaagctccccacaatcgctgccctccatcacgtacggagcgtttgctccaatgctgtgccggcaagaaagttattttcagcccttcatcttccagttgctgataccagccggcctcaatcactctcatttccggaaaccagctctttatcagttctccggttcccaaaccgcaaaacaatttcatctgcggattattattcagcaaacgggtgatactttgcttgtccagatggtcaaaatgatcatgactgataagcaggtaatcaatttctgtaaaaatgtcgggattggcaggaaactcactctgtcttttcacaaaagggatgtttccgaaaaccggatcgaacatgattcttttacctgccaactgaaggaagaaggaattatgtcccagccatattaaagaatctcccaccacagcatccagcgaacgaagataacagactttcgggtcccacttcaccgttttcttttctttccgctgaggattgggggacaaccgccatttcaacacacttcccataccggggcggaaacggtgctgcctgttaaaaaaacgtccgcgtaccatcggatttcctctccaataaggattaacggtagccaaacgttcgtttctcctgaaacatatatgttcacccattttctttatctattgaataagtcctcacaaacttaattaaaaatctcgatttacaaagagggacaaacaaaaaatgtaccccagacacactatcggggcacatttctcagaaaaagaataaatattattcttttttaatagaacgatcttacattaaaagcaatgcagtccatacaacggcagctgccatccgagagctgacaaattgataatcacgatgaccagtcccaatacccataggataaacagagaccatttcaagccggtccccatcggtgaccaatgaaacaactgacgcattatagtgtacagaaaagctcctaatggaatggcaatgagtgcaattcctgaaatggtgccaagcaatgtcatcacaggagatatggtagctatgggcgtccagtcaatagccggaagcatttcataaagcagagctccgccgccaacaagcgcagcaatcaccgcaaacacaagagctactatcaccacagcgagcacgaacaataccggacagcaaatgatgacaagagctaccaggaatatcttaagaatgatagcggcgatcgtgacaaatacatctcctactttttgcagaaaggtacgcggtttatccgagttcacaaagttattgaccccgtcggcaacccgttcaaatccgtccgtcaccgttttgcctatattttctatggttaccgcttcgccacgcatactcagcttctctgctgccgtacgtgcttcgggaatgataatccatcctataatataaaggataatcatcgggcaatagggaacaaacaataatacgatcatcaggatacgcaccagcgtgatatcccagtcaaaataagctgccagcccggaagctactcctccaagcaacttattatccggatcacggaacaggcgacgggctgtagtggtccgtgtatacccctgaccggaagaagctgtctgttccttcttatgcggttcggattcgtcgtcagatacaccaaaatcttccggtttgcctacccgggcaattatttcttccacatcggcaatagtaatgacttgcttccctgcggacactttctcggcaaacagctcggcaatacgaatctcgatatcattcacaatctcttccgccccctcctgtttgcgaaaaaaatgtttcaggttggacagataatcgtccagcaaacgataggcatcatcatctatatgatagacagttcctcccaaatttacagttaatgtttttttcattattatttcttctttatcgaattatctactagcaatatgattcacggtttcgttcagttccttccaggatatctcaagctcgcctaaaaaagcctctcctttttctgtgagcttatagtacttgcgaggaggtccctgcgtggattctacccattcataactcaacaaatcgtcattcttcaaacgtgtcagcaatggatataaggtaccttccaccacaatcagctgtgcctctttcaacttctgaataatatcagaagcataagccggctctttgtgcagtaaaagcatgatgcaatactccaacatgccttttctcatctgagattttacattgtctacattcattgttatttttctttttgacaggacaaatatatgcattactctagtaccttgcattacaaatcttgtatcgtcaataaaaaggagatcaacttgatattattaaataaaagtacaattataaatcagttagactatgttagaaaatgaattatggggaaatactattgaaaactggggtatttccattcttattattttaggagcaattattattgtgaaattattatcgctattaggcaagaaagttatcaaaccttttgttacgggaaccgacaatcacctggacgacgtcattttttactctttggaagcgcctgttaagtttgctataattctgttgggaatctggatcgctatccatcggttggtttatccggacagttttgtgaaagtagttgacaatgcttacagcattttgattgttctggatattacttggtttttcggccgtttgttcagtagtttacttcaggtttactggggaaagcagtccaacggacaagctaacaaaatgatgccaatcatcaaaagaaccatcttggttatagtctggctcatcggcatcgtcatggctttgagtaatgtgggagttaacatcagcgctctgttgggaactttgggtattggtggtatcgcatttgctttggcagcacaagatacagtaaaaaacgttttcggtgcgtttaccattctgacggataaacctttcagcatcggagacacaattcgcgtggatagttatgaaggaacggtagtagacgtaggagtccgaagcacaaaaataatgaattacgacaaacgtattataactttccccaattataagattaccgatacttctatcgttaatatttcatccgaacctatgcgccgagtagtcttgaatcttggactgacgtatgatacgacttccgaaaagatgaaagaagctttagaactattgaaatccatccccaaaagagtagaaaatgtatcttctaacccttctgatatagtcgctgtttttacagaatactcagattccgcattggttatcatgtatatctattttatagaaaaacaaggagatattttaggcgtaacctcaaatatgaatatggaaatactggctgcttttaataaagcaggattgaaccttgcttttccgacacggactgtctatattcagaaagacgaatcattgaaacaagaaaattgataaacccatcgttctcttagaaatatgtacatgcagcccaacatcaatgtgctatttttaagattaaacaaaaatacagttgagataaaaatgataaaacaaagaataaagcgcataaattagtgcaataatatacggaataacagattattattgcataaattcacatgagatatgcatctttttctatcactaaaccactcgttggtattaaaggaacgcctccttggtttaaaaccaacgcattcttcctcaccgaggaacctgtttttcctcggtgaggaagagataaaaagactacccggagcttgttttcacgctggttaatcacaaatagcgaaaaggcaagattaaacaaaaagttatcctttcagccaatacatcatccaaaagaaaacataagaagtaatatcatatcaatctattcagcatacaacttaaataaaagaaaggaagattttcattcaagcaaatgcaggcgtttttctacttcttatttatccgtaatgtaatttatagcattccttggctgattaaatattcctttttttaagaaagtgctttttttcagcaataggtaagcctgagtaatagttaacgaacgactgacaatacacaaacgatcatagtaattagtaagtctgcaagatcttttcgagacgcttatttcccgcgtatcttggttgataacttcgcaaaaaatcaaaagacgcaaacccgctatcttcagaatgccgcctatgtacggttgaagaatttgcagatcgggtataccatccccgcccagatcacacgcaaaataggtgtttccaacctgagcgaaagacggatcgaacagttcaggaaaaacttatccgttgtcccgtactttttccacaggatttagtgttaacttttaattgatgacgtatgaaaaagataattaaatatttatttttgctgacagggggaagctttatactcgcttcttgcaatgtttttttggacagggaacctttagacagtgtgaccccggacaactttttctttactgaaaatgacttggctgcctatgctgtaaagcattacaacttcaggacgcatgagggatttaatgccggaatctggaaaaacgacaatgctacagataatcaggctgccactgactatgataagaaatggattcccggtcaatggaaagttccggaagcttatgataatccagcaagtaatgatccgtggtatttctctgccattcgtgaagctaattacttcctcgcaacagtagtgccccgcttcgaaaatgaagcgcattatctgaatcctatcgctatcacgcacttcagaattagagcctcaaatcctaacgatctgagtacttctattatttaccagaatccaggatggccaattcaagccaatgaaggcccgataggtattaaataaagatataggtcatttcggatatggtaaaaagtgtaggacgcaccgggctaatgtttaagaaaaaataaagctcagcgtcctatgcttcaaactattggaaaatttgtaccttggcgggacgaagttctaatgcaaaacaaaacagtctgacattaatatattaaagatagatcaatcaagcaaatctaagaattatgaaaagtacttcaacatggtggaaaatcttactcagtggtctgttattggctggaacactggtagctaacgccgacacttaccagccatcttactccacagcaggcttttatcagctttccaacacaggccgcacagtgtataacatgaatcctgcctggcgattttataaaggcaatatcgaaggagcggaacagccgagattcaatgataaagactggaacatcgtatcattacccgatggcatagaatatctccccaccgaagcgagcggatgcatcaattatcagggggaaatctggtatcgcaaacacttcactcccaaggagagttggaaaggaaaacaacaattcctccacttcgaagccattatgggaaaatcaaaaatatgggtgaacggaaagttgctgaaagagcatttcggtggttttctacctgtcatcgtagatgtcacttccagtctgaagtatggagaagacaatgttatcaccgtatgggcagacaacagtgacgatccctcctaccctcccggcaaaccgcaagatgcactggactttgcatattttggaggaatttaccgagattgctggatgatagttcacaacaaagtattcattaccgatccgaattatgagaatgagacagccggaggcggattatttgtctctttcgacaaagtttccgagcaatccgcacagttgaaactggatgcacatatacgcaacacttccggaaaatccttcagtggtaaaataatctatgaactctatgaccgcgacgacaaacgtgttctctctaaggagaccggtttgtcggtaagcaaggatcttgcgaaacaaatttcttgcaaagtgaccgtagaaacacctcatttatggtcacccgacagcccctatctttacaaactacacatttatataaaagacaaagccggtaacaccatcgacggatattaccgccgtatcggcattcgcagcattgaatttaaaggaaaagacggattctggctaaatggcaaaccttacccctatcctctgatgggagccaaccgtcatcaagattttgcagtgattggtaacgccttacccaacagccttcattggcgggatgcgaagaagttgcgtgatgccggaatgcgtgttatccgtaacgcccattatccgcaagatccggcgtttatggatgcttgtgatgaattaggactgtttgttattgtcaacacaccgggatggcaattctggaatgatcagccgatatttgctcagagagtatatagtgatatccgcaatatggttcgccgcgaccgcaatcaccccagtgtatggatgtgggaaccgattctgaacgaaacatggtatccggctgactttgctaaaaatgtagtggacattctcaatgaagaatatccgtatccttattgctatgccggatgtgatgtaaccgcacgtggacacgaatactttccgatacacttcacccatccgatgaacggaggtggaggagcctttaataccgaaaatctggatccgaaaatcagttatttcacccgcgaatggggagataatgtggatgactggaactctcacaactcaccaagccgggtcaatcgcggctggggagaagtaccgatgctgattcaggcacagggatatgccaaaaacgattaccaactcaccagttatgatggactatacagaacttcaagacaacatatgggcggttgcctgtggcactcgttcgatcaccagagaggatatcatcctgacccgttttacggaggtatcatggatgccttccgacaacctaaactatcttattatatgttctgttcccagcgtcctgccgaacccaacaaagaattgatcgcagataatggaccgatgatttacatagccaatgccatgaccccattctctccgaaagatgtaacgatatatagcaactgtgacgaagttcgcctcacgtattgcaagggaggcaaagaatatacttatcataagccggcaaatgaaagcggaatgccctcacccgtcatcacattcaaggatgtatttgatgtcatgtatgataaaaagctgtcacgccaaaagaaacaggcagattcttaccttctggcagaaggattaatggacggaaaagtggttgcgacacataaagtaacacccacacgccgcccgtcaaaactgttgctttgggcagatgacgagaaagtacagatgaaagcggacggatcggacatcgtgacggtcattgcagccatcgcagatgaaaacggaaacatcaagcgtttgaataattatgaagtaaagttcgaaatcgaagggcagggccaactagttgccaatgaagaaacattcaccaatccacgtccggtactttggggaactgctccggtgctggtaaggtccaccactacaccgggaaaaattaaaatccgtgcatcagtggtatggcaaggcaaacatacgccggttccggcagaactgattattcctacttttccatcagaacatacgctggtagcagacaaagatgaactgacacaagcacaatccgcaagcaaagatgccggaaataaaataaatgccgctccatccgattgtgagaaacgtgtacttgaattacaacaggaactgaaccgcctgaaactgaaagaagtcgaaaaacaacagagtgactttgaataatgcgcatagttctatctataaacagaaaaaacacaaacttattaaaatacagttatgataaatagaatagtatatacttcatttttattaggagcgagtttcgccagtacagaagcacaggtaagtactcctcccaatattgtattgattttatgtgacgacatgggattctccgatctgggttgctacggaagtgaaatccagactcccaacatagaccgtctggcagaaaacggggtacgcttcagcctgttcaaaaatacaggaagaagctgccctagccgtgctgctttgctgacaggacattatcagcacgaagccggcatgggatggatgacggcagtagatgaacaccgccccggatacagaggacaaattacaaaaaacatccccaccattgccgaggtgatgaaagcgaatggctacagcacatatatgagcggtaaatggcacgtcacagtggacggagcttttgatactcccaatggcagctatccggcccaacggggatttgacaaatattacggttgcctgagcggaggaggcagttattataaaccaacaccggtatacagcaatctgacccgaatcaaagaattccccgatgactattactataccactgccatcaccgattccgccgtcagttttgtcaagcaacaccctacagacaaaccgatgtttatgtacgtagctcattatgcccctcacttacccctccaagctcctgccgatcgtgtagagaaatgcagagaccgatataaagtgggatatgacatgttgcgtaaacaacgtttcgacaggttaaaggagctgaagttcatttcggacgaaatggattatcctgtctaccaaaaagaatttgacggaaaacgtccctcttgggaaacactcacaccaaagcaacaggagcaatggattaccgatatggcaacctatgccgccatgatcgaaattgtggatagcggaatcggtgaactggtggaaaccatcaaggagaaagggatgctggacaataccgtatttatcttcttaagcgataacggtgcaaccaaagaaggcggatacctgggccagcttatggctgatttgagcaatactccttatagaagctataagtcacaatgttttcagggaggcacaagtaccccttttatcttatcttatggcgatgccgaaaaaaacaagatgaaaggtcagatttgcaggcaacctgcccacattatagacatactgcctacctgcatggatattgccacagctacttatccgtcagaattcaaagagaatttgcccggcaagagcttactccctccaatccatggaaaaaagataaagcccagagaattatactttgagcatcaaagttcctgcgccattatttccaatcattggaaactggtacgcggcagccggaatgaaccatgggagctaatcgacttatcggcagatccgttcgaaaccaaggatttgtccgcccaatatccgaagctagtgaaaaaactagaggctaaatggaataaatgggcgaaacaatgtaatgtctttccactcgaaaacaaaccttggaccgaaagaattaactactatctgaaacaaaatccggatcaaagcggaatagaataaaatccgggaacaatagtcttcttaatactaggtttagaaaaaagactgttccttttagacgaacagtcttttttctgtttacaagacatattgtttgtatatagctgtttttttattacttttgtgccttcagccccaaagagctgtaacacacttaaattcatgaaatatacttttatctaataataaacacgctacgacaatgagaaagaaacattcgctcctattttgtgccttatttacgatttttacgggacatgcagaagatacggattataccaaaggactttctatctggtttgattctcccaatacattacaaggaaaagaagtctggcatagttccaaacaggatgccagttgggaatcacagtcattgcctataggtaatggaagtatcggtgctaatattttgggttcaatagaggcggaacgcataacttttaatgagaaaacgctttggcgtggcggtcctaatacagccaaaggagcagattactattggaatgtgaacaaacagtccgcgcacatcctggacgaaatacgtaaagcattcgtagaaggagaccagaaaaaagcggaaaaactgacacgcgagaatttcaacagtgaagtcccttatgaattttccagagaaaagcctttccggtttggtaacttcactacaatgggagaattctatgtagaaacaggattaagcacaataggcatgagtgactacaaacgtatcttatcattggattcggcaatggcggtggttcagttcaaaaaagatgacgtagcatatcagcgtaactattttatttcttaccctgccaatgtgatggtgatgcgtttcagtgccgaccaaccgggcaaacagaatctcactttcagatatgcccccaatccggtatctacagggcagttctctgccgacggtaataatggtcttgtttatacggcttctctggataataatggaatgaaatatgcagtccgtattcaggcaacagtaaaaggcggtaccttaaacaacacagatggacggattacagtgaaagaagctgatgaagtcgtattctatgtgactgcagataccgattataaaatgaatttcgcaccggactttaccgatccaaaaacatatgtcggcgttaatccgcttgaaacaacccagcaatggatgaaggatgccgtatccaaaggatattccaacttactggacgaacactacaaagactacgcttctttgttcaaccgagtgaaactggaattgaatcctacagtgaaaacatccaatctgcccactgctcaacgactgaaaaactatcggaacggacaacctgactactacttggaaaagctctattaccagttcggacgctatctgttgatagccagttcccgaccgggtaatatgcctgccaatctgcaaggcatctggcataacaacatagacggcccctggcgtgtggattatcataataacattaatatccaaatgaactactggccggcctgctctacaaacctggatgagtgcatgctcccgctaattgatttcatccgtaccttagtgaaaccgggtgaaaagaccgctcagtcttattttggtgcaagaggatggacagcatctatttccgccaacatctttggctttactaccccattggaaagtcaggacatgtcctggaactttaatccgatggcaggtccctggctggcaactcacgtttgggaatattatgactataccaaggacctgaaattcctgaaagaaacaggatatgaactgattaagagcagcgccaactttactgttgactatctctggcataaaccggacggaacgtatacggctgccccctctacttcaccggaacacggccctatcgatcagggagctacatttgtgcatgcagttgtccgtgaaatcctgctggatgctatccaagcgagcaaagaattgggaatagacaaaaaggaacgtaaacaatgggagcacgtgcttgccaatctcgtcccttataaaataggtcgctatggtcagttactggaatggtcaaccgatatcgacgatccgaaagacgaacatcgccatgtaaatcatctcttcggtctgcatcccggacacactgtttctcctgtcactactcccgaactggcagaagcagccaaagttgtattggtgcatcgtggtgacggagctaccggctggagtatgggatggaagttgaaccagtgggcacgcttacaagatggaaatcacgcttataccctctttggtaatctgctgaaaaacggaacagtagataacctttgggatacacacccacccttccagattgacggaaactttggcggcacagccggtatcacagaaatgctattacagagccacatgggattcatccaattactacctgctttaccggatgcctggaaagacggctctatttatggcatatgcgcaaaaggaaatttcgagatagatattgcatggaaagacggacttctaaaagaagcgactatcctgtccaaagcaggacagaattgtatcgtgaagtacgccggtcaaacaatctcttttaaaacagtgaaagggcgtagctatcagctaaaatacgacaaagagaatggattaataaaaatcaaataataacataacactttaacctatgtcatcttagatgaatacaaaaacatttacccccaaatcgaccatgaaaatttatacttgtctttgcttgcttttcttagccgattatctggttgcccagaataatacttcggcattgttgcctatgcccaatcagataacttcagtaaaagggaaaccctttactgtccgttccggaaaaacggccatttatttgagtcagccggagttgcagttcactgccaatacgctgcaaaatatattatcagacagaatgcaagtggaaattccacttgcttccgaatccgaccgtgctgatatccgcttgttaattgaccctgcaatggaaggaaatgagcactatcgcatcgaaataacttccaaaaggataactatcagcggagctactgtacgagctgtttattatggagttatgactatggaccagcttcttttaggtgatgtatgcgccactacacaaaagaaaatttctcctgtctacgttgatgatgcgccccgattctctcatcgggcattgatgctcgaccccgcccgtcattttcttccggtcaatgatgtgaagttcttcattgaccagatggcacattacaaatacaacatactccaattgcatttgacagatgaccagggatggagagtcgaaataaaaaaacatcctaaactagttggcaaagattattatacccaagagcagcttgccgaaatcattcaatatgctgcccaacggaatatcgaggtcattcccgaactggatatccccggacacaccgtagctatattagcagcttatcccgaattaggatgtactcataccgatacgctgcctaagatagtaggcaaaactacggatttaatgctttgtgcaaataatcagaaagtgtattccgtctatcaggatatcatcaaagaaatatcttctttgtttccatccgattatatacatttaggaggcgacgaagctgttatagaaaagaactggactcaatgtacccgttgccaggccatgatgaaagagttaggctatcagaaagcttcgcaactcatgattccttttttcagccgcatgctttcgtttgttcaggaaaataataagactcctatgctttggtgcgaactggacaatatttatccgcctgccaacgactatctctttccttatcccaagaacgtaactttagtaagctggcgtggaggattgacacctacttgtcttgaacttacccgaaaacatggcaatccgcttatcatggcaccgggtgagtacgcttatctggattatccgcaactgaaaggagatttccccgagtttaacaattggggcatgcccgtcaccactttggagaagtcttatcaattcgacccgggatatggcgtgtccgctgaagatcaagcccatatcataggagttatgggcactttatggggagaagctatacgggatataaaccgggcaacttatatggcatacccgcgcgctttcgcactggcagaagcaggatggacacaaatgaaacatcgcaattgggaatcattcaaacaacgtctttaccccaatctgactaatatgatgaagaaaggggtttcggtacgtgttccttttgagatagttgacaggaagtaaaatctcaattataagccatttaatatgctatttcaactaaacatgagatactagctatttttagggatagaacattgatgaagctattcaaatagtatataaagtggaagcatagtactattatttattatactagtacactctttcaagaaattaatcaattcattctgaaaaacattctgtttaggagtcaattctcctcctaaagtcagatcaaccgaacataataaaaagattataattattactgttcgacgggctgcgatatttcctattttcataattatttcatttcaaacacaccaaaattttataaaattatttctctacattttataaacaagcaaactacttaccagcactaactaacataaaaagacaatcatgatcatcaaagttattatcatatcggttcaattgacataaaaggcctagtcattggtgtgtccgcattaggaacatcaaatccgctaaaattaaaataaacagtataatcactatccggattctttgctcgaaaatccgctttaaaataattcttataggttccttttcccttttctattgtaggagcatcgtattgttgcacaatttgaaatcctatacttttaagaaattcaacccactgattgtatgatctacttctatcaaatcctaactgctgaaaattaggtggcagttgatgatagctacctattattatttttcgaaccttcccatctttagtatatacccaacatgaattaattacataccgacaactgccatcgtcctcttttttcttttctgtataattcattgctttcacagccgattcagttgtattaaaatcaatcccatatataggtaaaagcgattccgacgtgccggacgaacttcgcactactcctgatgaagaagaacaataatccgccaattcctttttaagcgtactgagctgatccattaatttataaaaagtgtatttgaaatgttctgcattaaccaaatacatttcagcatggtaggcatagctatcttcaaaacaaaccacctttacagctttatatgcatttagttctttcaatgctttggacactttatcgacagaatatgtgtcattataaatataagataaccccacagttaaatacatgggagaagtatcccttttatcaatcgatatgaaatacttgtcaccttcttttttgaattgaatattaccgttagtattcaattccggcatatacccttcttccttcaaaaatagcataatgtctgagcgcaacttcttttgaatttcagtaaactcctgtgctaaagaatccatgcttaagcttaataaagcaacgagcaacaatattatctttttcatacatattaaaaattacacaagttattataaaaacaaattacttccttatagaacgcaattgccttcccttactatcaaacagtattcccgttatgaccacactagagggcaaactttctgattttatcttagtaacgaccaattttatactagcaaaatactcatttacttccgcttccgtcatttcatattttgatttcggagttttaaaactgagctcgcacgaattgctaccagtaactaaaaatgacgatgcaactaaatgtttagtattctctccaaaatcaataggaagttctgcattaaatttacgtacatcttgctgccaatttcgggaaattggttcgggtgatgaatttacccactcttttccgttccatttttgtgtcagcagaatccgtccagatgcattcgtgtatttccgagattccatctcaccatctttattataagtcaattcgattttgctatagccatccttacaatcaatagacttgccatttactcccaaataggataggctaatagcctgttgattatcattatactcatacacttctttgaagtaaccatcaggacaaagcataggtttattcattatatcataataacatttttccttctcattacctgaagaagtataactgataacagctttgtggtatccatccatacggcttatcaaaggcttctcattctcatcaaaataagcttccgataataattttccacgagaattatattcgcttttctggatactccaacctgttttcggattaataattaaatgtcccttcccatctccagcggccaaatatatcctatttccccatctgtcatatctacacagaccttctggtaccatcactttcggatcagtaggcttcccatctataccgaagaaagactgctttaagacattacctaaaacatcatactcacgagtagaacttgcccagccttcgtttgaaaccactaattgtttatcttttccataataagaagtacgaacaatataacctcgttcatcatattcatccttttggatcgcatatttatcattattataggaagtcagctccccatcttttccatagtactcaatttcaatccgctgatttctactattatagatacagacatatttatgataatctaaagaatttaacgctggtttattgtttctgtcataaacggagaactctatttgattatcaaatttatcatatttatatcttgctattagttttcccgaagccaactgttcatcagtaccaatttctattttctccagtatattacctcgtttatctcgtttataattagctccagcagaaccatttaccatcatcaactttccacttaaattataataacgcaagttggtctcattaccttgttcgtcaaactttgatatccattttgcacaacttccagcacatacggtaagattgtttttatcatcaaagaaactacgttctgtttcattcccattatcatcatatacagaattccaccctgcaatattttcattactcaaaactaaagtctttcctccagcatcataaaaagaaactttgatttgatttcctcttttatcataatctcttgctgcaataacaattccattattatctttacatggcgataaatcaactcctatgtttactaacttagtgatcagattcatgtcattatactcagccttatacccagccgttccatccgatttcaaacaaggcttttggtctataccatatgtgacatactctattatattaccaattgaatcatagttgagctttactccggcataaccttcgtttatttcatttagttttccatcaagtccataaaaccacatttcctgaacatttcctctattatcattgatatatttagcagatgagtttccgtcattagacaaacattgatttccatcaacatcataaaaagtttgatttataatatagccattatcatcaaatttacgaacgacctttgaaaatccgtcattaggtataaaacatgcctttctatctatatccagataagaagcttcgatagggaatccatgctgatcgtatatatatttaatcccagcaactccattctttttaggcaacatcaatttcccgtcagcatcttgatgaagggcatataccacatttccgtatttatcatactccatcacatacacaccaataccatcagcgtcatcataagcaggtttaccatctacagtcaaatactctgcttttacccaattatcgttctcatcataataaaatttcttcatccctaatccccattttgtagctttcggagtaccatcaaatgacaaatagtgttcgctcaaaacacgacctttctcatcacgcacatatttacgcccataaatattatgcgcatcaccaactaatacattttggaaacctgcatagcgaattgttgacacatatccattttcatcatactcaagcaaccatctggatatttttcctttttcaactccattatcctccaatgcacgcacatatcctatagtttgagctcccaaagtcttttccgttccatattcatcatcatattgaaatattacagtattcaatttatcattatatgacttcacatacaatactttcccacttctatccaacactttcgcacggcttatattccccttatccgtataatacaataacatatcaagcggtctttcattacgctccgattcaccatcctcgataatattctccttgctgttcacatgagacatacgctgtagtttatgttttttatattcaaaacgatacagcctgttcacatgactcatctccctgctactcaattctccgattccctgaggaactccccattgttcgacataatctttataataatacactttcgtacgattataatcccaaaaataaactccacctcctatcatcagcaagacaatagcagccacactcgtccatacccatttgggaatcttaggaggataaatgacccgatgcaatgcctttttaaaatcgtcacatgtctgatagcgttctcccggttccttagcagtagctttatctacaatcttctgtactttatccgatacatatttataataggtccgcatccgtggtaatggctcttcaactactttcttattaatatcatattcagtaagtgtggtggtatcataaggagcattccccgtcagcatttgatgcaacattacgccaagcgaatatatatccgatctagaatctaaatgatcacctctcacctgctccggactcatataggaaggtgttcccatcaccatatcatccttctccacagattcccgattgataatagtagcaataccaaaatccaaaattttgggaatgccttctttggttataataatattcgcaggctttatatcccgatggataatattatgttcatgagcatattccactgcatctaatataggctcgaataacggacaaatcttatcttccacgatcaaaccagaaacggtctgtatatatttgtccagactaatgccatcagcatattccataatcaggtagatactacccaattcgtcaatatggtaatcatggaaacgaacaatgttctgatgattaagacttgccaaatgttccgcttcttctttcagacgttgacgggtaaaatcattaaccatgtcactattgatcaccttgatggctaccttttgttgtttaatgtatttgtgttctgctaaatacacactacccatccctccttttcctatcaaagagacaatggtataattaagaacctccttaccaatcattttattctttttttaagttaacgaaagaatgttaataaaaactcccaatccaaaacctacccaagcccaagtcgcagcttgagatgctcggtgaggagtttcccctttccaacagaaatacataatccagcctgctaacggaataaaaaaagctaatattccccagccaatttccaattcatcttttttatacgatctatattcctgtgaagaagatacaggaatatgttcgactattaaggtatttgagccgactttagtttcttgttcataaggatgagcgcctctaataggtaacaaggcataaatttgcgcccatggcagaggtatatggttggacagtaacacagtagcaccaggagcaatcacgactttttcattaagaataatacgcccaccaatattactcccgtttttactgacatctttatatacatacttattatcaaccaaagtaatttcagcatggacgcggctcactctctcatctgcaattacaatatcacagtgactacttcttcctattgttattgttttcatatactacttaagatattaattataaatccgactacaaaccctatccaaccacatatagcagccgctcttgctcgtcgaggcgtctctttcttccactgtgcccaaagtacccatcctacaattggacataccacagacaaaattccatatcctatcccaagtttatcttccttgacagatggagttggaggagtaggaggcaggatatctcctaccacttcttccattatgacagttcttcctcctttatcccgaagtttctgtatgacttcgtcccaatctaaaagatattcgcttctccctgccagccagacattcggcaatggggacggattctcaaaagaaaatggtattttaatgctcccatgacgtaagtatttgccatctacactggtgccatttgtactactatctgtaaataggagatagcgatgtatcgaacctgtacatctttcctccctatattctatttccagatggtgaccgctgatataatcactaggaatggttatgtcacactctctccgcccaacagaaacttttactctattcgggtctaccaccgtttctctaaatagtcctgatttaaattccatcaccgtttgaaaacgacgaagcatatttttatctacagccttcaatatcgcttcttgagtttgatcagataaatgcggattaaaagtctttgcacgtggaaattcatcattcaaaatagagcaaatagtatcataatcatttgaccgctttttgatggcatgagaaccagtgagcatataatgtaacaaacaacctaaggaataaatgtctgtgcgataatctatgctatctcctttagcctgttccggactcatatatccgtcggtcccgataatacgtccgattgttttgcctgtgctggttttcatatctttagcaatcccgaaatctataatgcagatactaccatcgggacgtaccattatattagaaggcttaatatcacgatgaatgcatcccatcctatgtatataagccattgcatccagaattttccccatcaagtcctttgcagtaaattccgtataaggtcctgccatttccacatggtgttcgatggtctctccgtctacatattccataggcaagtacatatttccatgctcatccgaaaaaggattgtcaacaatgcctaccactgaaggatgccgcatctttttcaatgcagcagcttcaatatagaaaagttctttaaactccgggttcatagtagctttactattcatcatctttattgctacacgtttcccatcgccacttctcccttcatagacgctgcccatgcctccttgacctattacttttatcaattcatattcaggcataactattttccttccttattaatattaagactaataattatattaagtaatacatcagtagagttctctccttctttctcttttccttttattacaatatctatttttttaggtggttctttctctgtaaaagagatatcaaatcctgtttccttttttgttttcttgaaataagttgcatcatattctatgtcagttatctgaaaatgacgattgagttttgaaggctgtgattgtccttcaactaaaaaacacgcattctcaccttcaataaaagaaaaggcttttcttttaggaacaaactgagcatcaactctatatgtaagagaatccacttttccagtagctgccacaatagcaacaatactaccatttgcggtattacttacatcatttacaacagagggagtagattcttgatgagtttgcttcggctgtgtcaatgtcatatcttttaccacaggaacaacaaatttgaatatcttcacagagtctgccaaagaaaaacgcaattgttcgtttttaaactcttgtcgaaacactaaaagacggttaccatatgccacatcaatatcctcatcatactttaatgaatcacttgacagagcacggtttatttctatcaccttttctttttctttgcccataaggatctccgtatgtccttgcttataatttatttctaaaatatcttcacctttctggaacttaatttcaggcaacataataattgtatcccttcgcataaaggatttatatatagtaatagattccgacttaaaatgcttattccaaaaataataacctccactggcgccaatacatatcagcaaaatgacagttaatatgatcattcctatttttcttctttgaggtttagaaggcgaaccaggagtaatagaaaactctacaatctctaccgttatattgtccaatcccccattgtcccttgctcgttgtactaaatagtccacacgttcctgtgaccccatttcagattgtctgctgacgatgcgttctatctccctatctgatatcattccgctcaatccatccgaacaaagcaaaaaacaatctccagcttcgggtaaaatcgcatcaggcagtactgtagccggtttcatattggcaatgcctaaagcatttgttatttcgtttttccgtgggtgatgttctgcctgctcattagtcagttgtcccatatccaccaacatctgtacataagagtgatccttggttagttgttttatacatctgttacgtattaggtaaacacgactatctcccacatgacctatataaactttagagtcacggaccaacaacaatacacatgtagaccccattccctgcaactcaggttgtatcattgcctgatgaagtatagccttattggcagcatcaatagcttctccaatggcttcacgaggatcttcataatactgtccgtcaagaaaaccatgaatcgcttctacagctaagcgggatgccgtagctcctccgacgtgccctcccataccgtcacatacaacagcagcaaggccattgatcgtttcgaagttgcccatactgtcttcatttgcctgacgtttgcagccaatgtcggtacgccctgcaatgtgacaatagttatatatattttcttctttcattgcctaatttgctttttattgaggaatagccaagaaaatcattttggtagctcccaaaacaataacatcattcgtatacaactgtacacggtcacctacaaatgttccattaatatatgtaccatttgatgaattctgatcagcagcccagaaaataccttcagcctctctgtaaagtatcaataaatgctgggatgacatattgctatctcctggaataggaatatctgaagtagcagcacgtcctatcacatttctcccctcatagattttgtatacttcgcccattggattctggtcgtaagaaaccagtaagcctaccaaacgacgattgtcagaagccattcctgttccacccgtaggattaacgtgacgaataacagtagcacctcccggattattttgaccacttttcccaaggtctattgtatccgtttctgcgttcatatttccacctagcacttgagttttacctgtcgttgtatcatcgtcgagtactctagttgaatgggaagaaggacaaaaaggacaattatccccataaatactcgaatcatattgatgtccgtttatacatttttttgttgccatagttattataatatttagtatgattatttaattaattccaccgctcgtttgggttgtacagcctgattgtagccttgcgacaatcctaaatatcccgaaacgataacgcccgcaaactttcctctttcgttaaatactggcgaaccgcttgccccctgatgtatcgtaatattatgcccatactgatattcgcctctttgctgagtaatctctccgctctgattattcgcttccaaaccgatctctgtatctcccaaaataaaagattgagggaaacctatagtatatactttcttgcctaactgtaactccttatccgtaacgatatcattcagatcaactatattaactactccatctggagtcttctttgtatttacctgtataattgcaatgtctatcttatcatcattactcactttacaaattgagcatgggataaagtcgtttaccgaactcacatgagtatcattcaaagcaactcctgtataaaagatattatattttactgtaacagcacgcgccaacgctaatgctcctgcattattgggataccttttcacaatagccatttgaatagtttcctttactttttccgctttttctttttctccgtccagcaacgacacaacatgtttattggtcattatcttaccatctgtagaaatgaaaaatcctgtccctgacgatccgcctactccttgacacacatcatctttatcgtccaaatagaaataattccacgaatcatctcccatatattcgcccaacaacttatcaccaacactcgctacataagcagttttttgataaatcaacacaaccgatttctggtatttttcgtagatttcttccggaggcaacgaccggtgtgtccaataataccagatacctacactcactgccaacaaaatcaaaaaggcactgccccactgccacaagtaccctcctttgggaggagtcaaagcaaatatattctcccactgcaacggatactttttagaaattagcactacatctcctttcaccaagacatgagacgaaattctgtttccattcacataagtaccgttcgtcgaattgttgtcaatgattaacacgtccccattagatcgttggcataatatagcatgttcactcgacacatcatcaaaattcaaccgaacttgagcctccgaagaacgtccgatactccgtcgatcttttacatcaggcggaataatcacctgtcccttaccagcagataccactgtcttctcaggttgctgtattattctattccaatcaatgcttgtattacccaacttcactttgtcaccatttgacaattgcacctgattttgtatacgcatgctgttaacaaaagttccatttttagaattaagatctttaatacatactataccagaactcgacacggtgatgacagcgtgctgtgatgatacgcccgggtcacttaccacaacatcattaacgggattccgcccaaccttgataactcgcatagactcttccttatttattattcgtatatttctctatatttcagtctgttacacttcaacaagcatccaaatgtagcaaattaatataataaaaaaaatcgcaaaaagtatcaattgtacctaaacggtcaaaaaaggggattattacttcaaaaaacatgcttattatgagttttttttcctatcgtaattaaagaactttttatagcggctgtctatctccgattttcatcttcaccaacactaatcgaaataccctatcaacaaaattagtttatagaatgaagtcttgattcattgacctgcccttcaaataattgccattgaatatatgtatttcaaaccatacaagaatgaatctttacctagtacagtaatgttatgataaataaggctttcttttttcatcaatctatggaaaatttaacttccatagctatagactccggtaggtttcataattgttccttcgctatcttcactcctttctatcataccgtaatcctgttaagtcatatcgtgacaaacattcctattaacatttctccatcatttcagataaaattataaaaaacattaagtttttttctatcacctatcacccaccgctccacatccatttattcatcgcacttgcagacaagatgacaagttatccgaacctatcaccacatctatcacctatcaccacttgtgtcatccaaaacattaatacttatcacctaggatattagtagataagttctactctattagaactaaacttacttttctctaatagataagttattttccacctattgaaaactataaacgcaatctctgtttttataaatgcactttatacactttacagaatttactttctggggcaatgtaatatctaacaattaaaagagctgaatatgaaatatttatataagataggattaatacttagtgttgtattgactgccggagcttgctccggtcagttggacacgatccaagagtatctggatgccggtgaaactatctatgcggcaaaaatggattctgttgacatacgtcctggatataatcgggtagaagtaacgggattacttaaatatggtatggatacagaaaggtgcgttattcattggacaccggacaatgactctttagtagtgcctgttaaacggatagatccggtagatacttttcgtgtttttatagagaatttacctgaaggtacttatcaatttgagattgttacctataacaaaagtgggtatcgttctatttcaacctcaaaaggaagtaaaacttatggtgatcggtacataagttctttacgggtacgttctttgttgagtacagaggttgaaggggaaaatctgttactaaatttttcctcagaaatggccgaagcattggcaactaaagtgttttatctgaatagtgccggcgagaagcaggaacaagaggtggcaagaggagataatcagattaagattactgattggaagccgcggggagcctatgaagtcaaaacatattatattccggaggtgaatgcagtagatactttctctgtttcttcaacgggggtattcccagaaaaaatagttgaaatggataaaagtacattccgtgaaataatactggataatgatatccgattgaacgcttggggaggagcattatggaaagcatgggataatgcatacgaaaatacaaactatgcacatagtgataatacgaatccgatcgtttttcctgcttggtttactttcgatttaggagagaaagctcttttaaagcgttttgacttgttttcggttgttcgtgatgatttgaattataatggaggaaatatgaagagctgggaaatctggggtagagaagatgaaccggcaaattcttcttgggatggatggactaagctgataacttgtaattctttcaagccttctggcaagcctgttggcgagaatacggatgaagacaattcttatatagcaaaaggagaaaagtttgattttccatcaggtattccggaggttcgctatataagaattaaggttctcgattcatggagtggacagggatatgtacagttctcggaatttacattttataaaagtgaataaaaatgaaacatctacttgctggtattttagtatgggtgatatggggactttgttcttgtcagtctgatggtaaggtgatcattccttcacccatttatgtagataatcactatcatggtccggctgatccggagataacctggaatcctaaaacagaagaatggatgattttttatacatcacgtcgtccttttaaagatcaggcttcttatgtaggaacgcctgtgggggttgctgtgtccaaagattttgtacattggaagtttgcgggatattgctcgttcgatggtgtaggcggtcagccggatagtgagaaaacgtattgggcaccgggtgtgattgtggaaggtgatagtgcccatatgtttgtgactttgaaagatgactctactccggtctggggtggacctagtaacattgttcatttctctgcacctttggaagatatgatttcagggtggagacgggtaaatacagtggtggatactccgatttctattgatgcgactgttgtaaagaatggtgatcgttgggatatgtggtatcgtgaccgtccgacagaagatacaggcggattgtattatgcacaaagtaatgatttgtatcattggacattaaaggggcttgccaaaggcgatattaataatgtcgaggtgacgaagcatacatatcaggagggggcttatgcttttcagtggaaaggttatttctggataatagctgatcctcataaaggattggccgtgtatcgttcgaaagatgcggagaactgggaatatcaaggaattgtcatgtatgaaccgggtactcggttctttgacaatactcgcgcccggcatcctagtgtcattatcagaaatgatcgggcattcattgtataccatgtgcaaccctttttaggatataatccaaatacacacgaggctggtgatgatgtttaccagaaactgagtttcttgcagatggcggaattggagtttaaggatggaaaacttatttgtgaccgtaataaggtactgtataaataagattgcaggatattggatgtcattatattagatattatttctgtaaatgagtaaatagattaagtaaagcgtggaatattaccacatatttcacgcttttactatatagatgtgtcagattaaaacaatatagagatgaaaaaactgttgttaatagaaattctccttaccataagttttacgcttatggcagaagatcccgctaagacttataagaacccggttgttaattatagtttgcccgatcccagtgtgatcagggcagaggatggatacttttatttgtatgcaacggaagatatcaggaatttaccgattcaccgttctaaagacttgatcaaatgggagtctgtcggtacagcttttaccgatgaaacacgtccgacttttgagccaaaagggaatttatgggcacctgacattaataaaataggagacaaatatgtactctattattcgatgtcttgctggggaggtgagtggacttgtggaataggcgtagctactgccgacaaaccggaaggccctttcgtagatcatggaatgatgtttagaagtaatgaaattggggttcagaattcgattgatccattttatatagaagatggagggcggaaatatatgttttgggggagttttcgcggcatatatggaatagagttaacagccgacgggctaaaagtaaaatctggagcagacaagaaacagatagcaggaaccgcttatgaggggacttatattcataaaaagaatggatattactatctgtttgcttctaccggaacttgttgtgaaggattgaaaagtacgtatcagacagtagtagggcgttctagttcattgtggggaccttatttggataaacagggaaggtctatgctcgataataaccatgtggtattgattcataacaacaaaagctttgtaggcacaggacataatgcggaactaataaccgataaagcagataatgattggattttatatcatggagtgagtgtttccaatccctatgggagagttttattgttagatagagttgattggaaaaaagggtggcctgttgtgaaaagtagttctgcttctacagaatcccccaaacctcatttttaaaacgatttctttttagatattgacaggagagattaaaataggtattattccaatataattagttgtttttttaggcagtttgaacagaatttttcttttatcggtcaatttgtggcattctgaacagctgatgtttgctaactttgccttcgtcatcaaagattttattttgtagaacagacagaattaagataacaacaaaatttaatactaacagaatcggagattgattgctactgattcgcataatttgatttatatgaatttaaaatgcttactttgtggaatagctattttggtatgtgtcggaaccgtaaaggctattgacaatgtgtcggaacgtgtatccgcatctatttctttgaaagtgccgggaaatgaggcaaaacagtacccgttgactttccagaagaccaaaaacgacaaaagcgcttatcagttggaagcctctgaaagaattccgttgacagtttatcaaacaatagaagaaaaaggcggaaaatcgcagataacagtatgtatcactgcattggaggatgtatattttaattacagtcaacaagtgtcaacagggttccgccatgatgactgccagttctacatgcccggattctggtatcgccgtaatcttcgttctccaaagtcggctccctcgtttcatacttcggatagttggttggtgcgtgaagataggttaagtacccctcttacaggtatctacagtgagggaaccaaacgttttatgaccgtaaaccgtatcgatcagttcgagaatgacgctttgactactcatcgggagggagaggttattctttccggtaaaacctcccttggtttcaccggctttgagaatcgtaatggcatagctacactttctttcggtttcccctatcaggaagctcctaagagctatattcgcaagctgacattggccccgcaggtaaaggcttttcagttgttgaaaaaaggtgaaaccgttttattgaactggactatttatgaagatgcagccgaagattactcggattttattcgtcatacttgggaatattgttacgatacttatgctccaaagccagttgatactccctattcaatagcggacatgaaaaatactcttagttcttttttcgtgaatagcttggtgagtaaaccggagttgacttactattcaggggtaggcttgcggacagatgattgtaaaagtaacggagaggcggaagtcggttttgtcggacgtgttcttttgaatgcattcaatgcttgggaatatggctgggaaagcaatcgggcagaactgaaggaaaacagccttaagatttttgacagttacttgaagaatggctttactgaggcagggttctttaaggaatttgtgaatctggatcgtaactttgaggaaccggttcatagtattcgccgtcaatcagaaggaatctatgcaatgcttcatttcctggcatacgagaaagaacaaggacgtcgccatccggagtgggaacaacggatgaagaagatgcttgacatgtttatgcaattgcagaatcaggatggtagttttccacgtaagttccgggatgatttttctatagtcgataagagcggtggtagtactccttcggctactctgccattagtgatgggatataagtattttaaagataaacgctatctggatagtgccaagaagacagcggattatctggaaaatgaactgatttcgaaagcagattatttctcctctacacttgatgcaaactgtgaagataaggaggcatcgctttatgctgcaactgctacttactatttggcattgataaccaaaggagaagagcataagcattatgccgacctgacgaaaaaagctgcatattttgcgttgtcatggtattatttgtgggatgtaccttttgctcccggtcaaatgttgggtgatataggactgaagacacgtggatggggtaatgtgtccgtagagaataaccatatcgatgtgtttatctttgagtttgcttccgtgcttcagtggttgtctaaagaatataaagaacctcgttttgcagattttgcggaagtgatttctacgtctatgcggcagttattgcctcacgatggtcatatgtgcggcattgccaaagtcggttattatccggaagttgttcaacatacgaactgggattatggaaggaacggaaaaggatattataacgatatctttgcaccgggatggacggtagcctctttgtgggagctattgactccgggacgtgccgaaaagatgttggttaagtaattcatctaatctgtgatatatatgctaaagaaacgattctatattctactgttcttctgcctgcttcttggaggaaatgtaaatagcagtacagtggataaaggtgataacaatgctccgtttgagaacaaacgtacggaaacggactacttgcctattgctgatccgtttgtgatgctttacaataataagtactatgcttatggcaccggaggtacagtgaacgaaggatttgcctgtttttcttctgatgatctgaaaaactggaaacgtgagaggcaggcgctttctgcagatgattcatatggtaaatggggattctgggcgccggaggtttattatattcaatcaaagaagaaattttatatgttttattctgtagaagaacatatctgtgtggctacctcagattctccggtaggaccttttcggcaagagtcgaagcaacctatctgggaggagaagagtatagatacctctcttttcattgatgacgatggtactccatacctctattttgtacgtttcacagatggaaatgttatctgggtagctcagatgaccgatgatttaatgaagattaaaaaggagactttatcggaatgtataaaagcagaagagccgtgggaactattgcaggctaaagtagcggaaggaccttcggtgctgaaaaagaagggtatgtattatttgatttactctgccaatcactatcagaataaaggctatggagtaggatatgccacttctaagtcgccaatgggaccatggactaagtatgacaagaatccgctcttgcaaggggatgagtctaccggactggtaggtactggacatggtgctccttttcaatgcaaagacggcagttggaaatatatttttcacgctcattggaataaagagaaaatacacccgcgtacttcatactttaaagactttaccatatctaaacaaggtgtcgtttctataaccggaaaggttattaaaccgaaagttataaagtaaacggttatctttattttttctgagcaaatattgttcaaaaagtaggagacttcagatattaatgattgatacgtcagatattaatagttggcatgtcaggtcttaacagttgagaagtcagttattaatgtctgataacgcaggcattagtgtctgaagtcaggtatattaggcattgttacaacagttatttatccttgccggaatacttatgtttgcttgtcaatctttccatacgtattgagtggattgcataagatatttattttattcaaactgatagagggatcgaatacggttcctctattgttttatactactgtatcgttgttttagttatgtatttccatgtatttgcatagaatctgttaacttttgaacaatttttgatacaccaaatattccatgtttgctacttttgtcttataactaactaataaatcgaatagcgcatcatattcaataaaccattatctttcaccggtttctctttgatgtttgcttattgtataatagtaccaatgatggaagggtgttctgctcacttgatttagtgacaatggcatctgttatttgagatattagattaactttgttgtatataatacttttttaataagatgaggagcacgttatgagaatattgcacagtctttctatattgattgtttttatctttcatactttttatgtatttgccgatttgaatgagggttatgcttttcgttcactggatataaataatggcttatctcaaaatacggttcacgccattcttcaggataaacagggttttatgtggtttggaacgaaggatggattagaccgatatgatggcatttcctttcgggcttttatgaaagagtccggcactttggggaataacttcattacctccttgtacgaagatcagcaaggacaaatctggataggaacagatgtaggactctatgtatattcgcctgagcacgagactgtggaacgttttataatgaaaagtgatttagatacagggatcgattatacggtcaatctggtgacgggagataaggacggaggaatttgggtggtgacacaatctcaggcggttttttattataatcctcagactaataagctgataaattatctgtcagatcaatccggcaggttgaaatttggtagtcttgggcaactttactttgattcggataatgtatgttggctggatatacgtgatggcaacttgtatttttcaaaggacaaactccaaaccttggtcccggtatttcctaaagatggaaatgaacctttcaaaggagaatatatatgcaaactacttcccggtccttataattgtatgtatgtcgggaccataacggggttgaaagaagtgaatctgaccaataagactgtgcgtactcttttatccaaagatgaatccggagatgatatttatgttcgggagatagcattctattcggatgatgagttatgggccggaacggaatctgggctttatatttataatttacgtacaaagaaaactgttcatttacggaatgtgagcggtgatccgtattctatttccgataatgccatttattcgatttgtaaagatcgtgaaggggggatatggattggatcttattttggtggtgtgaactactatcctaagcaatatacttattttgataaagtctatccccggacagaaattgatgaaatggggaaacgagtgcgggagttttgtgccgatcatgatggtactctctggatcggtaccgaagataaggggctttttcattattatccttctacagggctgatcgaaccattcaggcatccggacatttatcataatgtacatggattatgtctggatgggaattatttatgggtcggacattttgccaaagggctaaatcggattgacttgagaacccacgctgtaaagcattattttgatgctcctaatgatatcttctctatttgccggactacttcaggtaatttatggcttggaacaacagccggattattccgttatcattctgaaacaaaccgttttgaacgtgtacctgaacttggttgggtatttatatataatatcaaggaggataaacaggggaatctatggctggcaacttacatagatggtgtatataagagaaatgtacgtactggtgagtgggaacattatatgcatgatgaaacgaatccttcaagcctgccttccaacaaagtgctgagtatatttgaggatagccaaaatcagctttggtttacaacacagggaggaggcttttgtcgctttgatccttctggtaagatatttgtgcgttatgattcgagtattggattgccgagtaatgtcgtacatcgaattgaggaagatgaaaaggggttgttttggattacaaccaataaagggctggtacattttaatccgaaaactttagaatttaaggtgtatacgattgctaatgggttactgagtaatcaatttaattatcagtccagttacaaggacaagaatggacggatatactttggtagtattaatggttttatttctttcgaaccgtctgtttttgttgacaatgattttcttcctcctgtggtaataacagattttatgctctttaataaaaaggttccggttggtagtacggactctccgttaaagcaaagtatcacattatccgactaccttgagcttcaatcgaatcagaactcgttttctttcagtgtagcagctcttagttatcagtcacctgatatgaatacagtattatataagctcgaagggtatgattcagaatggtattcggtgggtaaaaatctgattacatattctaatttaccctatgggacgtatgtgctaaaggtaaaggctgcaaatagtgatggaatctggaatccggatgttcgtactttaaagatccggattctacctccgttttatttgtctgtatgggcttatatcatctatgtaatattaatactcggagcacttttcgctactttcttctactttagaaagcgggcagtcgaaaagcaccagagagcgatggagaagtttgagcaggaaaaagaacgggaactttatacttctaagatagagttctttacgaatgtggcacatgagatccgaacccctctgacgctgatcaaaagtcctttagaaagtgtacttaccgagaaggaactgcctgaaaatgtgaagatggaattagaaattatggaccagaatgcagaacgattactgaatctgacaaatcaattacttgatttccgtaaaacagaaaataaagggtttaagttaaatccggtagagtgtagcgtcggttctattattcgttctgtttataagcgcttcaccactttggttaaccagaaaggaattgagcttaaggtagagattcccgaggaagaattattggcttctgtggataaagaagctttaactaagattctcagcaacttgtttacgaatgctttgaaatatgcccaaacatatgcttatctcagcttatctgttgatgaggcagggaaagagtttactattgttatgagcaatgatggaaagataatccctattgagatgcgtgagaacatatttcgtcctttcgtacagtatcgggatggaaaagacatagttccgggaacaggcattgggctggctttggcgcgttcattggcagaattacatcaagggacgttaacgatggatcaagatatggagtgtaaccgcttcatcctttccattccgatacggcatcagacggcttcggatgttttggaagaagaacatcgtgaaaagccagtgtatgatgaagaagataatgaaacacgtataatgccttctgataaggataaaaaggaagttgcttcggtcttgatagtagaagataataaagatatgttggcttttgttgcccgacagctctcgccattataccatgttataacagccgagaacgggatagaagcactaaaagtacttgaacacgagtatatcaaccttgtgataagtgatataatgatgcctgaaatggatggacttgaattgtgtgagcatttgaagtctaatttagactacagtcatattcctattatattgttaacagctaaaacaacactggagtcgaagattgaaggactggaacaaggagcggacgcatatattgagaaacctttttctgtagaatatctgcgtgtcaatgttgccaatctgttaagtaatcgtgaaaggctgcgtcgtcgttttatagagtctccttttataaaggccgatacgatggctcaaacgaaggcggatgaagtttttattcagaagttgaacgagtatgtatctcagcacctcgataacaccgatctggtgattgatgacatggcggaagctatgaatatgggacgttctaacttttaccgcaaactgaaaggagtattggatatgagtccgaatgagtatcttcgtttgatacgtttaaagaaagctgcccagcttctgaaagatggaagatatgggattgtagaaatttcttatatggtaggattcaattcaccttcttatttctcaaactgttttaagaaacaatttggagtgttaccaaaagatttcatgcaatgaacaaattcttataaaattgctctaaaactgattctgactatctctgcactgttttttggatagaatttaataatatcaggttaatttcttatatccttttcaggtaggttccgataactttgcgaatgtctcgaaggtaggaacttattttctgaccagtctatttggttgggaaaaaactttcttctagatcaattaatatagaagtaacggataaataccagattagaaactggctttataagctattaatcaccacaggcttctataataattaataaggtaatcgttttctcccatgaatagtgagaaaaaatattctcaaaaaaaataatccgtttaacatttgaaacatagcaagttatctctttcatcaaaaaacaagtaaaaaaaatcttgctaaaagatttgcgtagtccaaaagttccccctatatttgcaccgcatttgagagagaatgcgggttcaaggaagtttgggtgagtggctgaaaccaccagtttgctaaactgacgtacgggtaaccgtaccgggggttcgaatcccccagcttccgcaagattctctagataaaaagagctaagttttatagacttggctctttttaaatctatcaaaagccggtgggttcgtctaacggttaggacacatgcctctcacgcatgtaatacgagttcgattctcgtacccactactcttattttagttagcctcttacattgaagtaagaggctttttttattgggttcatatctcaagaaatggaatataacgtaaaagaattaaaaaaggtattgattgaacaatgcaaagaagaaggtatttattacgcattgatagcaatcaacaaacaaacgaaagagatcgttttgccacaaagccttgataacgctttaaataatccggattactgcgtctttaaatgcaggaaagtgaaggatgaatataaagtagaagaggtaaaataagcataattaaaaaagaaggatatgcttattgatattgtattaagatgttaaaagatttaataattatttgagcattcaaagttttttctgtaaaagaatgttatatccatgtaaaacgattgtctttcacatggatacccgtcaataaatgaagaaaaacgctgcttacttacatttcttcactctgctcgtacaattcaaagtaagactctttatcaatccgcagtcggactctgttttcccgcttctgaccggccagattgataaataaattgaagtataattgactaaaagagaggtcggaacgatcataagtgatatcgaaagtacaggttcttcggaacgaatcgaaagtccccagcttcatacctcccttgcacataaagacttcggggaaattcgcaggcggataaggctgaaacaagctggccagctgcgcatacacataatcgatcatccattcgtcaccggatacaagcaattctcctttcagacgaagtttgactgcatatttagctgtaacgtcctgagaagtataaatagggacctgactctccgacgggtaattgccatccttatagcctagactcatggtcagttttgatttacccactccgttgaaatctgcgacgttctgatctttctgttgatttttcaagtcaatcataaacgtcagtttacccaaagtcgggtcattcggatattgagctatcgtatccagcacataatcttcttcattgaaacttcgcgctaccaatacatcctcctctccgacttccaacgccggacctcctctttcaatatccacatcgcctacagggtaatatattgcatcattatctctgacacaacctgtcagacaaagcagtaaagctgccattcctactatcttattcattatcatatacatccttattttggagacaaagatacatcttttttgaatcaacttgatttatatcaaccgtttttagtacttttgcacataacaagactataatgacatggatacactactaagagaaactgtaaataccgtcgtaaattcccgctttcccgaaatgagtatagagggacgccggcagatagaaagcatcctgatacgtgaagaatatcctaaaggagtgatcgcacttaatgaaggagaagtagcccatgaattagtttttgtcgggaaagggatgctccggcaatattattataaaaacggaaaagacgttaccgaacacttctcatacgaaggctgtatcctgatgtgtatcgaaagtctgctgaaacaagtccctacccgattgatcatagagacactggagcctgctgtcatatacctgttcccttatgacaaaatgatgcagctgacaaagcaaaactgggaaatcaatatgttctatcggaagatacttgaatattccctgattgtatcgcaaaccaaagccgattcctggcgtttcgaatccgcccgcgagcgttataatctattgctcgaaactcatccggaaatcatcaaacgggcacctttggcacacatcgcttcttacctgctgatgacaccggaaacattgagccgagtacgttcaggcgttctgtagttttgtaattttggaagctatctgcttttccggtattctttgggagacataccggtataatgcttaaagtacttaccgaagaacgactggttggcaaagtttaaacggtcggctatctcctgtatgttcatgctcgaagaattcaagagtgccttcgcttccaagatcactaattcgtcaatccactcccctaccgtcttcccgctgacttccttgacaactccggacagatgtttcggcgtcagacacaactgatccgcataaaacttcacgctgcgttccgactgataagactgaaccaaagattcatagaagcgctcaaatatatattctttacgacttttacttttgacaacggcagaagcatccggagcataactgttgaaaatattgcaaagctcaaagaagaagccctgcatcaatcccattactacctccctacggtacctatcgtctttatttttcaatctctttctgatgaaagcatgatactccttaatcatctcctgctcgtgcagattgagatcaaaacaagggtaatctttcagaaagaaaaagaatgaaagcacattaccaactttgggcaatgattccaacagactttttgatacagcaaagaaaatccctctgaaattggaactgaactgacgatgttcgattatctgattgggcaacgcaataaccattctgcccggaatcagttcaaactcacgcagactgatattaaaacgagtagagccttccagacaaagtccgatgctcaccacttccagtttactggggccattataaagggaaataacgctctccgtgtcgaagagcgctatatcattgccgaccacatcaatactacccggatctatatgtttagaatgaactaccgaagaaatacctatcttaggaacaacttgcatatccatacactctctcttttggttgcgacaaagataccagtaataatgagatgttcaacctaaggcgagagattatctgtcaaaaagaacacttttgcctacttattgactatctccgaataaaaacttataatcacgttcggcagccggaacagtccacttttcaggaacgaatttccattggttcaatgccttcgggtccatagtacctttcttttctatataattcatcagatagaaacgaagatccttatccgtagagaagatgatacgctctttcaatttctcctgcgggatgcctgatcctttcgtcagcagttctccaccgccattcccccggtaagagttcaaagccaccttataaatcttatccatgaggaaaggactgccgtctgccatgctgataatcgtaatcttttccccttgcggcttggtgacgtctacggtataaataattcccgatgctgaatcaaaattgaagctgaaattttggaaagaagctctgtcctccgcaccttcgcgacgtttctccttaaaccagagcagatgatcgtccggagacttcatccggttggtccacatgaaataagacatttccagataatccttgatttcttttccggataaagtcatcatatatagcatattctcatacttatacagattgaacatatcactgacaaacacatcccctttatttattttcgcatcaaatgaaagcggtgccgcaaaggatatctccgcaccggtgatttcaagctgcaaggtatggatcaagtcgataaaagcagacgatccgaagaaagaaggacgggtcgagatactttcagtgaatgtaccgatctttttagagacaaagttacggacagtgtcatattgaggagcaaaattcttcataaagtcctcactgattccataatctttcgtttcggtcaatactccttttatatctttgctgcgcactttcccatctttcagtttcaaggtcacatcgatgttggacagaacaattccgttgcttgccggatcaatgaccagtaccgaatcacctgccacattcatcactttcttacattcgcgcgcatgatcgtgtcccatcagtacaatgtcaaatccggggacattcttcgccacactcagagaagcgttttcattatacttgccggacattttgaaagcctcctgccccgcatggaacaagccgatcatcaagtccggattctctttttcacggatgatcttcatccatttgcgtgcagtctcctccatgtcgtcgaaacgcagtcccttccacaggttctccgagagccatgcagggatagcaggggtgatcattccaaggattacgattttcactccgtcacgttccatgaccttataaggaggaagatgaggttctccggtcgatatatcgatgatattagctcctaatacgggaaagtcacaggtatttatccagcggtcgaacacggctcggcctgtctccacatcatgattacccatatttccggcatcatatttcatgtaattcatcatttccgcgcataggtggggtgatactgtatctatataattatagtaataggcagtcggttgcccctgcaatatatcgccgttgtcgagtaaaataagattctccttatattgttcgcgttctttctccacaaaagcgtatattcgtgccagactgccctgccaatccttacgggtaataaaattataaggataataattaccatgtacatcacttgtctgtacaattttcagcttcactactttttcctgtgccgcaattgagagcacgaggcaaagaagccatacgtaaacacatgcaaatcgtttcattctttttctattttaagcggatgtgagaacatgaaccgtgcacctcccgtatattcggagtcgatccatatatcccctttccatttatgcacaatcaatttacagatagataatcccaaacctgttccctgggcatattcgttcagcttctcgaagcgctcgaataccagtttctgtttctctttcgggatgccgcaccctgtatccgtcacagagaatacagccatctccgtctcttcattcaccgaaaattccagtgttatctgccctttcctggtgaacttatccgcattagacatcagattgataatcacctgctgcatacgctgtatgtctgtcgtcatccgaaacgactcataatcgctgacaaacaggaactgattgccggactgccgtgaaacgctgacagatgccaccacctgcctgcatagctgcaccacgtcacactcttcccaagtcaacgtgaccctgttcgcttccaggcgtgagagatcaagaatatcattgatcaggcgaagcaacaaatccgaatttgtcttgataatctgataataggtctgctgttcttcttccgtattgccacccacagcgagcacatccgagaaacctacaatggagtttaaaggcgtacgtatctcatggctcatattggcgaggaaagcacttttcaggcggtttgattcttctgcacggtcttttgccacccgcaggtctttttccgacttcagcagatcgtccttcagacgtttggtgcggaaatagtagaagagcgagatgcacaaccccagcacaaggatgacaaccagcgcacatgccgaccaaatctgataagtatattgctgatagaatgatacggtctgattaataatctgcacatcaaaaggaaggatgtccgggtccagtccccactccttcaccttccggctgtccagtacggccttgctgccaatcacggaaaggtgctgctgctcatccgccggatatcgatcaatctgtacggatgccaatgccatgtccatccccagtttccggtaatcgggcagcactccgccgatcgcccaataccccagactcaccgatgagggagtaaaagtcggaatggtcggagtaacctccatcatggcataggtagcattccgcatgaaataaccttcgttcatatccacacgccacgtgcctaccatgatcaccgtattctccggtaaatgacgcaactcttccacaattgtatagatagtatgccgccggccgtccatcaggatcaggtcgatttcgggaaacttcttcatttctttccgcaccagtgcctgcatggtgacgccgccgtaagtattgtccgaaataaaagcgatgtgttccgtcttcggataaaacgccttgatcatccggacattatcttctatattgtactgattgataaatcccgacttcaattccggtatattcatgtggtcggtaaagagatcgaccgattccggcatccatgcgtccagtccggcaaccgtatcctcaggcagtatgacgatgttgctgctgacgagactacacatcaccggcaccttcacctgtatcgaatcccgttgcgacagatacgccgcccacgcttcctgtcccaacagaataatttgcgccggatgcttctccccttgatatttagaaagaatctgcgtcatcataccgctccaaagcggggcttcggagaaacttttgcagttcatgttttcaatgataatatcgcgtttccctcccagtttgttatattcttccatatagtcggagatagtgaccgaagtttgatgagcggcgggattgtaggagcagataatcaggatgggtttctgatcgttagagacagcaaataactctgtggcccggaaaagccatagcaaacagataaacaggcaccctatatatctcatcatactcgtaagttttgaagtgttactatctcattttagcttgcaaatatactaaaacttgtcggctataacagatttatgtgtatttttgtcgctcattcattcgcaaaaaaattgtttatggaactatttcaccaaatgatttccggattactggggataccggaaagacaaatcagcagtaccctccacttgttggacgaaggtgccaccatccctttcatcagccgttaccgtaaggaagctaccggcggactggacgaagtacagatagagaacatcaaggagcaacatgacaagttgtgcgacatagccaaacggaaggaaaccatcctcagtaccatcaacgagcaagggaaactcactccggagctcgaaaagcgcatcaacgccacctggaatcctacggaactggaggacatctacctcccctacaaacccaaacggaagacccgtgccgaagcggcccgccagaaaggattggaaccgctggccatgatcatgatgctgcaaagggagcccaacctcaccgccaaagccgccaccttcgtcaaaggcgacgtcaaggatgcggaagacgcactgaaaggcgcccgtgacatcatcgcagagcaagtgaacgaggacgagtgtgcccgcaacgccatacgtaaccagttcacccgtcaggcggaaatcaccgccaaggtagtgaaaggaaaagaggaagaggccgccaagtaccgggattatttcgacttctccgaatcgctgaaacgctgcacttcccatcgcctgctcgccatccgccgggcagaatccgaagggttgctgaaagtatccatcagtccggatgacgaagcctgtctggaacgcctcgaccgccagttcgtacatggcaataatgaatgcagccatcaggtaaaggaagccactgccgacgcatataaacgtctgctcaaaccttccatcgaaacagaatttgccgcccagtccaaagaaaaagccgacgacgaagctatccgcgtatttacggagaatctccgccagttgcttctctctcctcctctcggacagaaacgggtgctcgccatcgaccccggattccgtaccggctgcaaagtcgtctgcctcgatgcgcaaggcaacttgctgcacaatgagaatatctacccgcatcctccggtcaataaaaccggtgaagcggcctccaaactccgcaagatgatagaagcctatgaaattgaagccatctccatcggcaacggaacagccagccgcgaaacggaagactttattaatcatcagaccttcgaccggcagattcctgtattcgtggtcagcgagcagggcgcttccatttattcggcatccaagatcgcccgtgacgagtttcccgattatgacgtaacggtacgtggagcagtctccatcggtcgccgactgatggaccctctggcggaactggtaaagatcgaccccaaatctatcggtgtgggacaataccagcacgatgtagaccagacgaaactgaagaaagcccttgaccagacagtggaaaactgcgtgaacctggtaggcgtgaatctgaataccgccagcagtcatctgctgacatacatatccggtctggggccgcaactggcacaaaacattgtcaacttccgtgccgagaacggagctttcagttcacgcaaggagctgatgaaagtcccccgcatgggtgccaaagccttcgaacagtgtgccggcttcctccgcattcccgaagcaaagaacccattggacaacactgccgtgcatccggaaagctaccacatcgtagagcaaatggcaaaagatttgaaatgtagcgtagacgaactgatcgcgaataaggaactccgccaaaaaatcaagatatcggactacatcacgccgactgtgggcctgcctaccctgcaagacatcatgcaggaactcgacaagccgggtcgcgacccgcgtaaagcgatcaaggtatttgaattcgacaagaacgtgcgcaccatcgcagacttgcgcgaaggcatgattctgccgggcatcgtaggcaatattacaaatttcggagctttcgtcgatataggcatcaaggagaacgggcttgtacacctctcccaactggccgaacgatacatctccgatcctacagaaatcgtgtccatccaccagcatgtcatggtcagagtgatgaacgtggataccgaccggaaacggattcagcttagcatgatcggggtacagcaagactgattgcctcccgtttttctccccaccaaacaattaaaatcgtaaagataatcatcagtactgtacaaatgagcgagccttcaaacccgaaggctccgccattcagtacgttctcttcgggcagatgcagcgtcagcagggatgtcccaaagtcatttccacttacctgatagcccagtatcgggccctgaatccagttccagaaaagatgaagggaaatagggaaacaaagattgcgcgtatataaataggaagcgccgataaacatacctgcaagtaacagattcagcataggcaggaaggcaaggttcggattgaagaggtgcagcaatgcgaacagcagtgcggagacaaaaagagacaggaatttattcatccgggtatgcagcagacggccgagtatatagccacgcatcatgatttcttcggccagagccaccagcaggcagaacacaaaggtagcaagcagattcagaggatcgaatcgaaaaccggttacttccacctcacccaaagccaaagacagtccgaagccgatcaagtagagaaggatggctgccagcagtccgtaccacaatccccgtgcatgacctttcagtgtcagtcccaagtcagagaaagggcgacgctcaaaatagagcagaatcactgccgaagtcagcacagccagcagcatgccggcttccgccaccatatgccccaacaatccggggtgccttgcctcatcaccaagaatcagagataaaactccgaagcctatcgtactatacaatccaaaggtgacgaaaagccccagtgcaaacaacaggatgcacgcccatacgggaagtctcttcggttctttcttttctctgatttcttctgtctccatttttactttttgttaatcacgctacaaaattagatataaaacataaaaaaacatcgtgtcttacctatttttcctatatttgtctgaacaaatctgcataattatgaaaataagacaactactgataagttttttattggctgccagtactttgggagcaaccgcacaagtaagcaaaacgtattatgtcagcaagcccggcacattgatctcgatgatgacggaagaagaagccaacagcatcacccacctgacactgacaggaaaactgaacgcagaagacttcagacatctccgcgacgagtttcccagcctgaaagtgcttgatatctccaatgccgaaatcaagatgtacagcggaaaagccggcacatatcctaacggaaagttctacatctatatggccaatttcgtccctgcctacgctttctcgaatgtggtgaacggagtgaccaaaggtaaacagacgctggagaaagtgatcctttccgaaaagataaagaatatcgaagatgcagccttcaaaggatgtgacaacctgaaaatctgtcagatacgcaagaagacagctcctaatctgctgccggaagctctggcggacagtgtgaccgccatcttcatcccgctgggcagcagtgatgcctaccgttttaagaacagatgggagcactttgcatttatagaaggtgaaccgctggaaaccaccatacaggtaggcgcaatgggcaaactggaagacgagattatgaaagctggtctgcaacccagggacatcaacttcctgaccatcgaagggaaactggataacgccgacttcaaactaatccgcgactatatgccgaatctcgtatctctggatatttctaaaacaaatgcgacgactatccccgacttcactttcgcacaaaagaagtatctcctgaagatcaaactgccacataacctcaagaccatcggtcaacgggtattcagcaactgcggacggcttgccggaacacttgagctgcctgcgagcgtgacggctatcgagttcggagcgttcatgggatgcgataatctgcgctatgtgcttgctacaggtgataagattacaacgctgggcgatgaactcttcggaaacggggtgccgagcaagttgatttataagaaataaaaaaagtataatccacattggacattgatttatgctatgtagaagatacgaggatagatcgaaaataaattagctattagcatatttcgattagctattagctaatttgtttttgctaatagctaatttcgatttgctcatagcgtatttgaaagaaaagaatgacaaaaccgatcaattatttcacttcgtcattggcatagagagaaaaagcttctcgtttgtcacaactttcttttatttcataatttctcccgattttcacaactcttttttcttatgacaatcaaggaaaagtcacgaatttccttcctttcaaagtccaataaagtccagaaagtccatattagatttttagaatacacaatctgcgatataacttactatatttcaagcattaacaccttaatttattaaataataaacacatgaaacgatatatatactcatgttggggtaccttttattcgaggagctatgtgaaaattgatttatttagataatatgaattttaatactgaattaaaaaagaatataggttgtaacatcgtatatagtagttctgatggaggtaattactcaattattcttatggaatttgatagtgggaatcgtataatgacatattgctattgggaagttcagaaagatggaaaatgaattgctacatcagaagatgatattacagctgtcatggtttgatggcacgaacaatttgacttttcgagagtcaaaaggttgtggatcttgaaatagatgaatcacttaatttattcattgaagtagaggatgggttgaaataaagtaaatttttcattttggtgattatgagaaaagtgattatttctttgatatacgtatcaatagtattgactattcccctggcagttgcctgtcagggggtaaattttacctaccaatgctatgaattacaaagataaatatattcttttttatttggaagggaaaaaagcgctgagtgaaaagagagttagtagaatattaggtatttcatatccagatgatatgcctgatggctatcatggacaagatccacgaatatgggtatacatcaaagataagtaattagataaatcagcttttacacaaataggttatgacactgaaattaactagaattttcatttgagatattttaatggtggagaaaaaatccgctgtaattgatatcatagcttgtggtagcctattaaattagaagatacgttcccgcatgaataccctcacaaattatatgttctattttgaagattacttttaaaaaggggatgttcagacttatcctgatagaagaaatactgcataaaaagctgcaagaatatgcaggaatgatcttgcttttggatataaataggtgaaatatgcatgataactaccaatgttaggagacgtttcatttaaagaaaagcttcgttggttttaaaggaacgactcgttggtcggtgagaagcacttcgtttcatttaaaggaacgggtaaaaaggtactttgagtgcttgttttgctccggatgtcgtcagttacagaagagtttgaaaatgttagattgaaagttaaatgatgaaatacatattcggaatttatgtttttgatcttatctgtgttttattgatcgctataaagtgaaatctgtgtaatttggaaatatgccaatcgcgaatccttccgtttttccagttcagtccgtacttgtgttgtatatttctgattctacgagatgattcctatccattcttcatgcactgagaaatcactgttctgattgaggaaagttgattcacatttaatttcatctcctgttttgagatacactttgaaataaatgtcagagtaacgttatattattaaaagtacttaacgaaagcccaatccatcactttttatttgtttctttgcaccaaattcgggaatagtgttgtcttgtgaatcgaggcagcacttaattttgcttagaaattaatggagaaactcattataaatgcttgtccggtgtgtggcagtacgcacttgaaacgcgtcatgacttgtacggatttttatgcttcgggcgaacagtttgaactgtgttcgtgtgaagactgcggatttacgttcacgcaaggtgtgccggtagaagcagagataggcaagtattacgagactcccgattacatttcccacactgatacgcgcaaaggcgcgatgaataccatctaccattatgtacgttcctatatgctgggtcgcaaagcgcgcctggtagcaagggaagcacaccgtaaaagagggcgtttgctcgatatcgggacgggaaccggatacttcgccgacaccatggcacgccgtggatggaaggtggaagcagtggagaaaagtccgcaggcacgtgcttttgcaaaggagcatttcgatctggacgtaaaacccgaatcggctttgaaagagtttgctcccggtagctttgatgtgatcaccctttggcacgtgatggagcatctggaacacctcaatgaaacatgggaaatgcttcgtgaactgctgacagagaaagggatgctcattgtggcagtgcccaactgctcttcctatgatgcaggacgttacggtgaatattgggcggcatacgatgtcccccgccatctctggcatttcactcccgtcactattcagcagctggcttcccgtcatggattcattatggcggctcgtcatccgatgccgtttgatgcgttctatgtatcgatgttgagcgagaaacatcgcggcagttcgtgcagtttcctcaaagggatgtatgcggggacgcttgcgtggttcagcacgttggggcggaaagaacggagcagttcgatgatttacgtattccggaaaaaaagatagcgcatgggaaataaaaacagatataagtcgaagtcactgttcgatatgcaattcataacgtccagtatcagtacgacattggtgttgttgctgttggggctggttgtgttctttgtgctcacggcgcacaatatgtctgtatacgtccgcgaaaatatcagcttctccgttctcatcagtgatgacatgaaggaggcggatattctgaaactccagaagaaactgaatcaggaaccttttgtgaaacagtccgagtacatctccaaaaaacaggctctgaaagagcagacggaggcgatgggcaccgatcccgaagagtttcttggctataaccctttcacggcctcccttgaaatcaagcttcactccgattacgccaattccgacagtatcgcgaagatagagaaaatgatcaagaagaactctaacatacaggatgtgctctaccggaaagagctgatcgatgccgtcaatgagaatatacggaacatcagccttgtgctgctggcgctggcggtggtgctcacctttatatcctttgcactgattaacaatacgatacggcttgccatctactctaagcgattcctcattcataccatgaagctggtgggggccagctggagttttatccgcggacctttcctgcggaaaaacgtgtggagcggcgtattggcaggtatgcttgccgatgccattctgatgggaactgcctactgggcggtgacgtacgagcaggagctgattcaggtcatcacccccgaagtgatgctcattgtctgcggcagcgtgctggtattcggaattgtgataacgtggttgtgtgcctacatctcgatgaataaatatctgaggatgaaagccaataccttatattatatttaggagaataacatatagttggaaatttagtaacttgtaacaaaataagcttatgtctgacaaacagaaatttgccttcgataaagtgaactttatcttgctcgcgatagggatggcgattgtcattatcggatttctattgatgacgggacctacgtcgtccgaaacggttttcgaaccggatattttcagtgtacgcagaatcaaggtagcacctgttgtttgcctgtttggctttatatcgatgatatacgcagtgttgcgtaaacctaaaacaaaagaataataaaaagaaattatgagttggttggaagcaatgatcctcggattgattcagggattgacagagtatttgcctgtaagcagcagtggccatctggccatcggatcggcattgtttgggatacaaggggaagagaatctggcatttacgattgtcgtgcatgtagctaccgtatgtagtacgctggtgattctgtggaaagagattgactggatttttaaaggattattcaagttccagatgaacgatgagactcgttatgtgatcaatatcgtgatttcgatgataccgattggtattgtaggcgtattctttaaagattatgtagaagctattttcggttcgggactgatgattgtaggctgcatgctgttgctgactgctgccctgctgtcattctcgtactattataagccacgccaaaaggataagatttcgatgaaagatgcctttatcattggtctggcacaggcttgtgcggtgttgccggggctgtcccgttcgggatctactattgctacgggacttctgttgggagataacaaggcaaaactggcgcagttctcttttctgatggtgatccctcccattctcggggaagcgttgcttgatagtgtaaagatgatgaaaggtgaagatgtagtgggggatatccctgcgttatcattgattgttggctttctggcggcttttgtagccggttgtcttgcctgcaagtggatgattaatattgtgaagaaaggaaagctgatctactttgccatctattgtgcaatagcgggattggcagtaattattacgcagttgtaagtcgtgagtcattttactcccactcacaactcgttatttataactctataacgtgaattttaaaaaaggagaagtactgtttttcaataaacctctcggctggacatcatttaaggtagtaggacacgtccgctatcatatctgccgccggataggagtgaaaaaactgaaagtaggtcatgccggaacgctcgatcctctcgccacgggagtgatgatcctctgcaccggcaaggctacgaaacgaatagaagaatttcagtatcataccaaggaatatgtagccacgctccggctgggcgctaccactccctcgtacgacctggaacatgaaatagatgccacctaccctaccggacatatcacccgggagctggtggaagaaacactgacgcacttccttggtgccatcgagcaggtgccccctgccttttccgcctgcatggtggacggcaagcgcgcttatgagctggcacgtaaaggcgaagaggtggaactaaaggcgaagcaacttgttattgatgagatagagttgcttgaatgccgtctggacgatccggaaccgacgatccgaatccgcgtggtgtgcagcaaagggacgtatatccgtgccctggcccgtgacatcggcgaagcgcttcagagcggagcccatctgacggaactgatccgcacacgtgtgggggatgtccgtctggaagattgcctggaccccgaacactttaaagagtggatcgaccggcaggaaatagaaaacgacgaagataataattaacgtaataaggaatagatatgaagctatcacaattcaaatttaagttacccgaggataaaatcgctttgcatcctacgaagtatagagatgagtcgcgcttgatggtgttgcaccgtcgtactggagagattgaacacaagatgttcaaggatgttttgaactactttgatgataaagacgtatttatattcaacgatacaaaggtattcccggcacgtctgtatggtaataaggagaagacgggagctcgtatcgaagtattcctgttgcgtgagctgaacgaagaactccgtctgtgggatgtgctggtagatcctgcccgtaaaatccgtatcggcaacaagttgtatttcggtgccgacgactcgatggtagcggaagtaatagacaacaccacttcccgcggccgtacgctccgtttcctttatgacggaccgcacgatgagttcaagaaagccctctatgctctgggtgagactcccctgccccattccatcatcaaccgtcctgtagagccggaagattcggaacgtttccagtccatcttcgccaagaacgaaggtgcggtaactgctccgacagccagcctgcactttagccgtgagctgatgaagcgtctggaaatcaaaggtattgatttcgcttatatcaccttgcatgccggtctgggcaacttccgtgatatcgacgtagaagacttgacgaagcataagatggactccgagcagatgattgtaaacgcggaagctgtcaatacggtcaaccgtgccaaggataagggtaaaaacgtgtgtgcggtaggtacaactgtgatgcgtgctatcgaaagtgcggtgagcaccgacggacatttgaaagaatttgaaggctggaccaacaagtttatcttccctccgtatgagtttactgtggccaattcgatgatttccaacttccatatgccgttgtctacactgctgatgattgtggccgctttcggtggttacgaacaggtgatggatgcttatcatgtagcgttgaaggaaggttatcgcttcggtacatacggtgatgcgatgctgattctggataaataaacgaaaagataccgctatgaaaatctgtcccaaatgccacgaagaagtagaagatagctttgaaatctgctggaactgtaattacagctttccggacgataagatattggatatgactccggcggaagagagtgatgacagcgggcggtctatcgactgtctgcgttgtcaggtcaggatggtttattccggaaaatatgagtttcatgaaggaatgaacacgggcatttttggaaacttgtttgagttattccagaatcgcgaagcattcgacttatacgtctgcccgaaatgtggcaaagtagagttctttgttcctttggacagggagcgggagtttaaggtagaatagaccggtaatggcgaaagtgtatataagtctcggcactaatctgggagataaagaacagaatctccggactgccgtgcaaaagatagaggagcaggtagggaaagtcatttccctgtctgctttttacatcactgccccttggggattcgattcggagcatagtttcttgaatgcggcggcgtgtgtagaaacggaactgtcgcctctggaagtactgcagaagacgcaggagatcgaacgggaactgggacgtacgcataagtctgtcggtggcgtatatagcgaccggctgattgatatagacctgctgctttatgatgatctgatactttcggttacttctccttccggagcagcactcaacctcccccaccctttgatggcggaacgtgacttcgtgatgcgccccttaacggagattgcccccgaactggtgcatccggtattgggaaaggcaatgaaggtgctgctggcgcagatagaaaaataatacagcattctcttccccttgcttatccttttactttttacttttcttttcggcgataaacctcggcagataagccacacagcccaccaatactgcatataacaagtgaatatcctgaaactcaatcttcaggaagtggcatacaatggcgtaaatggcaatggtgaatcctatataaagcgccagtacaaaaagagttcttaatttattgttgataatcatatttttttctgtttaggattaggatggcggaggaataaatgacggttcagaaggcagatgatagttccgccgattcctccttttgcaaactcatacgtccatgaaaattcgtctcctttccagaaataatccatgacgaggaagatgatgaccagaaggataatggaaaatacatattgcattaatgtaattgttctcataccaatttcctgtatatatgtgttaaacattgcccaaagataaatataatctccgaataatacctatctttgtccccgaaatgaaagtgtggacagatttgagcagcttgcaaccacggaaaaaaatgctaaaacacgtcttgttgacgccttttcggcaatgcttccgcagctctcttcctcccctctttattttcccaattttaattttcaatttataatctttaatttaaaaagatgggatacttatttacatccgaatcggtgtcggaaggacaccccgacaaggtagccgatcaaatatcggacgccgtgcttgacaaactgttggcttacgaccccagttctaaagtagcttgcgaaacactagtaactaccggacaggtagtattagcgggtgaagtgaaaactaaagcgtacgttgacctccagctcatcgcacgtgaagtgattaagaaaatcggttacactaaaggagagtacatgttcgaaagtaactcttgcggtgtgctttctgccattcatgagcaaagtcccgacatcaaccgtggcgtagagcgtcaggacccgatggaacagggtgcgggcgatcagggcatgatgttcggctatgcaacgaacgagacagaaaactatatgccgctttcgcttgatctggcacaccgcattctgcaggtgctggctgatatccgccgcgaagaaaaggtgatgacctacctccgtccggacgccaagagccaggtgacgattgaatatgacgacaacggaactcctgtccgtattgatactattgttgtttctacgcaacacgatgactttattcagccggctgatgactctgccgaagcacagctcaaagctgacgaagaaatgctgtctatcatccgtcgtgacgttatcgaaatcctgatgccccgtgtcattgcttctatccatcatgataaagtactggcattgttcaatgatcagatcgtctatcacgtcaatccgaccggaaagttcgtgatcggtggtcctcacggagataccggtctgacaggccgcaagattattgtggatacttacggtggcaaaggcgctcacggtggtggtgctttctccggaaaagaccccagcaaggtggaccgtagtgccgcttatgctgcccgtcacattgctaagaatatggttgcggcaggtgttgccgacgaaatgcttgtacaggtgagctatgctatcggtgtagcacgcccgatcaacatcttcgtggacacttacgggcgtagccacgtgaatatgaccgatggcgagattgcccgtgtaatcgaccagttgttcgaccttcgtccgaaagctatcgaagagcgtctgaaacttcgtaacccgatctatcaggaaactgccgcttatggccacatgggacgtgagccgcaagtggtatcgaaaacgttcttctcccgctatgagggcaataagaccgtagaagtagaactctttacatgggagaaactggactacgtggataagatcaaggcagcttttggtctgtaattttatttgaaatcagcttatagctttacggctatttagtccatagtgagccgcaatctcatctcttcttatacgggagagatggattgcggcttttgttattcgggcgattttataagttacgacttataaataggttgaatttgaactgtttataagttatgattaataaaatcgttatatttgttgcggttgacaaacttgtaaacagcagatgactattttttgatttctgacacaaagtatgggttgtgatatatagtacatgacttggttgtgagaagtacttcagttgctgggtttcagtactacagttaggttgatgatgtataacgtttggggcggagatgtacaacaattgaatgaaagatgtatgacttttattctatgctattattatcctgtaatctgcattcagctttttcagtttcgtccgcaagctccctgtcagaaggggatagcggctgaaaacactgctttacaaccccgtctctgacatactttgaaagggggcaggtggtttcagttctttcagccctgacatacgggctaaattttgtaagccctgagctgaacttcattcatcgccgagctaaagtctgttcgcctccgaggtgaaagttggcgagctgccggcttatttcagatcaatcaagcgaagagtgtgttctgatcaaacagagggtctgtttgccttggatacaggctctgtttatcttgaatacaggctctgtttgaggtaaatgcaggttctatttcaactgttggcagagtttattcattatacacagtgactcggatagtaattagcggaaagcctgtgtaggaatgaataaaatatggggagatttccaactccttgaatggtgctggctgacttgcggaatggtactggctgacctgcggaatggtactttctgacacactgagaggtaccatctgatatcttgaacggtatcaagttcgaaattgtttttggggactgaaaggactgaagcaccttactcccttcataaagcttcaagaatggagttgtaaaactgtgccttcagccgctatccccttccgacagggcgtttgcgggtgaaactgaagattctgaatgcgggtatttcttctttgtgtggaatatcagagatttagttcatctttttaaaaagagacaatgaagtcatctaggtttgcgggtgtcccttctttattgaatatcttcttataaagctgttttctgctcatagatacagcgctttgtgtacgacataccaattgtgaaattgtagaaactggaattttaatttttaacagtaaacaaatacgtagttccatcttggtaatagagggatgcagtatgaataacttgttggtgaaattgtcatatgtatcattaatgatattttctagttctttccattctgtttcggtgagtctgatcgaggaatcttctatcgcacgataacaataagcataaatatcagaccttctaagcgcttcctcaagtaatgcttgttctctttgtgatgtttcgatagcttgattggtttgttctagcttttccttttttgcaagtaaaagtttttgttgtaaatcattgttttcctgttcgaacgattttaccttttcttttaattcttcaatttttttcttgttttcttctatatatagttggcttttccgatattgttgttcgttaatctcatgaagttttttctcttgttcccgaatcatagctttcctgtttctattatatcgaataaggatgataactcctaaaacgatggcaataacaataaagatgatccatgctcgttgttctgcatttttcttgcgcaaatattctttttctttctcaatatgttggtaatcatacaaagcctttatttttcgcaaagattctgtgttggatatgtcgtaaatgctatcagaacattctgtatatttctccagatatgctaatccttcttcatagttgccacgttctttttctatttcatataaattccgataggctcctatgtctgaatatacattattatgtcctatatttttcttgaagtaataggctgctgaatctttttgtcctatacttacatagaaatttccccaaacatcataatttatatctttctcatcttgccatttactatttgtttcttgtagcgttttcaatgcttcgtcatattttcccatttgaatatagatgcctgccaattcttcgagaatatttacttccctttgtatgtctccattgctattagctaattggtatgctttgttataataatagattgtgctgtctgttatctcaagtaaattgaatgctcttcctaaatctcgtagtgcataagcgctagtaagactgtctttgcctagttgtaagtagtgataagcgtttcgataagcttgtagtacttcctctgtgagaccttcataggcaaatagagttcccatttggctgtatattcgccccaataaagcgtagttcttgctatctgtagagatatcaaaagctttgtggaaataagaaagtgctgtaggaccttcatgaagatcaaggtatactctgcctgtgtaataataggattttatcagtttgtccttatcattttctctttcataataatcagtgacggataacattagagaatcagacgtatgaggcacgtaacatctgtcacgtgcctctgttaacagcaggtaatagtacattcttgctgattgtgattcctttgtgatactctcactcagagagtctaaaatggttaatgcactatctggatattctttaataatattttccacccgcagtattgtgttggggtatggggcagtgcatgagaataggcatataatgcttaaatagaatagtataaattttcgtctttgtttcatttgaatgtatgtatcattgcgattttatttgcgcaaatatacgtattaggtattaagtattaaccttgcggataaggcagtctactttatacctaatatttaatacctaatacttaatacttaatactttatattaatgggattattctcttttacacaagaaatagcgatggacttggggacagccaataccatcatcatcacaaacgggaaaattgtggtggatgagccttcggttgtggccttggatcgccgtacagataagatgatcgccgttggggaaaaggcgaagttgatgcacgaaaagacccacgaaaatatacgtactattcgtccgttgagggatggagtgatcgccgacttctatgcttgcgagcaaatgatgcgcggtttgattaagcaggtaaatactcgtaatcacttgttttcgccgtcacttcgtatggtgatcggtgtaccgtcgggaagtacggaagtagaactccgtgccgttcgtgactcagccgagcatgccggtgggcgtgacgtctatctgatattcgaaccgatggctgcggcaatcggtatcggtattgatgtagaagcgcccgaaggaaacatgatcgtggatataggtggtgggtctacggaaattgccgttatctctttgggaggtatcgtttccaacaactctatccgtatcgccggtgatgatctgactgcggatatccaggaatacatgagccgtcagcataatgtgaaagtcagcgaacgtatggcagaacgtattaagatcaacgtaggtgccgcactgaccgagcttggcgatgacgctccggaagattacatcgttcatggaccgaaccgtatcacagctcttccgatggaagtgcccgtatgttatcaggaagtggctcactgtctggagaaatccatctccaaggttgaaacagccatcttgagtgcattggaaaatacgccgcccgaactgtatgcggatattgtacacaacggtatttatcttgccggtggtggtgcattgcttcgcggactggacaagcgtttgacagataaaattaacatacctttccacattgctgaagatcctttgcacgcagtagccaaaggtacgggtgtggcattaaagaatgtagaccgtttctctttcttgatgagataaataatacggatcattattcatgcggaatttaataaacttccttttgaaatacaattactggttcctcttcatcgtattagaggtagccagttttgttttgttatttcggttcaacaactatcagcagagtactttttttacatctgccaatgtcgttgtgggggcagtttatgaagtttcgggaggaataagctcttatttccatctcaaatcggtcaacgcagacttgctggatcgtaatatggtgctcgaacagcagatcactaatctggaaaaggcgttgcgggagcatcaggttgattcggtcactgtaaacagcatcaaggagatacctctgacagattatcagttgttcaaggcacacgtcattaagaacagtctgaatcaggcggataattatataacgctcgatcagggttcttcttccggcatccgtcccgaaatgggagtggtggacggaaacggaatagtgggcattgtctatgaaacctcctcttcgtattcactcgtgatttcggtattgaacagcaagtcaaatattagttgcaagattgtcggaagtgactactttggttatctgaagtgggagcatggagattcccgttatgcgtatctgaaagatttgcctcgtcatgcagagtttaatctgggtgatacggtggtgacaagcggcttctctaccgtattccctgaaggaatcatggtaggaacagtcgatgatatgtccgactcgcacgacggattgtcttatttgctgaaaatcaagttggctaccgatttcggcaaggtgagtgatgtgcgggtgatagcccggaacggtcagcaggaacagaaagaactggaaaataaggctgtgaaataatgataattacctatatacatagaatcggatggtttatcgggctggtacttcttcaggtactgatcctgaataacgtacatattgccggatatgctactccctttctctacatttactttatactgaaattcgcttccggaacttcccggaatgagttgatgttgtgggctttcttcttcggactaaccattgatatctttgccgatactccggggatgaatgctgcggcaaccgtgctgctggctttccttcgtccgtccttgctgcgcctgtttactccgcgtgacaatctggacagtatcatcccttctttcaagagcatgggcatcactcctttcctgaaatataccacggcaagtgtttttgtccatagcctggcattactcagcattgagttcttctcatttaccagcatctggctgttgttattgcgggtgatttcgtgcacccttctgactttaacctgcattcttgctgtagaaggaataaggagataggaatggcaaaagactatagattagaaaagcggaaatttgttatcggggggattgctttaactattgtgttgatttatctgatacgcctctttgtattgcagataacgacagacgactacaagaagaatgccgacagcaatgctttcctgaataaaattcaatatccctcacggggtgctatttacgaccgtaacggcaaactgctggtattcaaccagccggcctatgacatcactcttgtcccgaaagaggtcgaaaatctggatacactcgatttatgtgagtcgttgggcattactcgtgctcagttccttaagatcatgagtgatatgagagaccgccgccgcaatccgggatattcccgatataccaaccagctgttcatgtcacaactctctgcggaggagtgcggtgtcttccaggagaaactgttcaagtttcccggtttttatattcagcggcgtacgatccggcaatattcatacaatgctgccgcccatgctttgggggatatcggtgaggtatccgttaaagatatggaggcggatgaagagggatactacatccgcggagattatgtaggaaaactgggagttgaaagatcgtacgagaaatacctgcgtggagaaaagggagtagagattctgttgcgcgatgcgcatggacgtatccagggacgttatatggacggagagtatgaccgtccttccattccgggcaagaatctgactctgagtctcgacatcgatttgcagatattaggcgaacggttattgaaaaataagattggaagtatcgtagctatcgaaccggaaaccggagaaatcctttgtctggtttcttctccgaattatgatccgcatctgatgattggtcgtcagcgtggcaagaaccatctgatgctgcaacgcgataaacagaaaccgttgctcaatcgtgcgttgatgggagtctatcctccggggtcaactttcaagacggcacagggactgaccttcctgcaagaaggaatcattaccgagcaaagtccttctttcccctgttctcgtggtttccattatgggcgtctgacagtgggatgtcatgctcacggctcacctttgccattgattccggctattgcgacttcttgcaactcctatttctgttgggggctgttccgtatgttcggcgatcgcaagtacggttcaccgcagaatgccatcacagtctggaaagatcacatggtttctcagggattcggctataagttaggagttgatttgcccggagagaaacggggcttgataccgaacgcgcaattttatgacaaggcttatcgtggacactggaacggactgacggtcatcagtatctccatcggacaaggtgaaattctgtctacccctcttcagatagctaacttaggggcaacgattgccaatcgcggacattttacaacaccacatattgtgaaggaaattcaggatgcgcagttggatagcatttatcgacatccacgcaacacaaccatagagcgaagacattatgaatctgtggtagaaggaatgcgtgctgctgccaccggaggtacttgccgtatgctgtccgtgatggtgccggaacttgaagcctgcggaaagacaggaacagcgcagaatcgcggacatgaccattcggtgtttatgggctttgctccgatgaaccagcctaagatcgccattgccgtatatgtagagaatggaggttggggagcgacttatggagtgccgatcggtgcattgatgatggaacaatatatgaaagggaagttgtcgcccgagaatgagttaagagcagaagaaatcagtaacagaatcattttatatggtaacgaggaacgatagtttgtggaaaacactggattgggtaacgattggtatctatctgcttttgattgtcggcggatggttcagcgtttgcggtgccagctatgactatggcgatcgtgacttctttgatttctctacccgtgccggaaagcagtttgtatggattatctgctcctttggtctgggatttgttttgctgatgctggaagaccggatgtatgatatgttcgcgtacattatatatgtagggatgattgtgctgcttattgttaccatctttatcgcaccggatacgaaagggtcgcgttcgtggctggtgatggggccggtcagcttgcaacccgccgagtttgccaagtttgctacggcactggcgctggcgaaatatatgaactcatactcattcagcataaagaaagaaaagtgtgccttcgtcttgggctttatcattcttcttccgatgctcctgattatcggacagcgggagacggggtcggcattagtttatcttgccttctttttggtgctttatcgggaaggaatgcccggtgtagtgctttttgccggtttgtgtgcagtgatttactttgttgtcggcatccgttttgacgaggtctttattgccgatactcccacaccgttgggcgaatttatcgtgttgttattgattctgttgtttgccggaggaatggtatgggtgtaccccaaaaagtgggaacccacacggaacattatcggaggaagcctgatcattctgcttatcgcatatttaatatcggaatacggaatacactttagtctggtatgggtgcaatgggggctttgtgttcttgtgataggttatctgctctatctggcattgagagagcgtcaacgttcctatttcctgattgctctgtttgccattggctctatcggcttcctgtattccagtaactacgtatttgataatatcttggaatcccatcagcaaatccgcatcaaggttgtactcggtatggaagaagacctgacgggagcgggatataatgtcaatcagtcaaagatagccatcggttccggtggattgactggaaaaggctttctgaatggcacacagacgaaactgaaatatgtgcccgaacaagatactgactttatcttctgcacagtgggagaggagcagggatttgtcggttcggctgctgtcctgttggctttccttatattgattctgagactgattgctttatccgagcggcagacttccatttttgcacgtgtctatggttattccgttgtcagtatcttccttttccatctttttattaatgtcgggatggtgcttgggctgactccggtcattggtattcctttaccgttcttcagttacggaggttcttccttgtggggattcaccattttattgtttatcttcctgaggctggatgccggaagaggcagaaggctttaatctattctccttgtttttcaatccggataccgacgtcattgagtccggttaatttctcatcctgcattccgtgcacaatcttaactgtgtagtttccgggatgcagcgggcggacagatttgacaaaaactgctgtttgatagatacttccccacccattgcctgtccatcttcctgtggaatcagccaggttgaccgctatcgtgtcagtgcgccatactgtggagtcgagcagattctcatgaatgaataagtaaaggttgcggtaagggtattcacttctgttgcgaacttccgcaaataatctgagtgtaccaggaatactgtccgtaacaggacactgaaaagagagtgtatcactctttccccatccctcattgggcagggactggtaggagtgatacacggtattttcattacaggctgccatgaggcaggcaccgaataaacaaaataagctattcctgagcaggcttttcattattttgcggtttctcttgattcgaatttctttcaggtctgggaatacgttcctggttgggttgtcttccttgttcctgcgggcgttcctgattttgaggacgttcctgtttgggttgccgttctctattctgcggacgctcttgattacgttcttgattgcgttcctgatttaccggacgctcttgattttgtgaacgctcttgattctgcggacggttcggattctgtggacgttcctgattctgtcctctttccggacgtctgttctcattattccgtccttgattctgtcctctgttccggttattattgttattgtttctcggacgattttctctgtctcctctttctcctctgttgccgttctctgacggttggggacgattctcgttctcccccctctgaggttgctgcggacgatttccactttcggcctgtgcctgcgggcggttgtcattatttccttttctcttcttcttgttccggttaccgttgtttccgtccttattatttcggttacggtcgaagcgggtgaggctttcctgttccagcaagtcaatcggctttttggattcttgcttcacttcagcttcgagcagactatccggtttcattcctttcttgttcatggcaattacctcaaaggcacgttttccactgattgttaccagattggcggggaagttcttgtccgtagagtaagaaacatgattactcagaatatcagccttgaagaagtagaaagtgccgtcctttgtttccagttcgatttctttggaagggaggcgcttctgagcttccacatagcagtccacctcatagttgagacaacactttaactttgcgcactgtccggcaagcttttgaggattcagtgaaatgtcctgaaagcgggcggcacttgtagataccgatacaaagctcgtcatccaagtagcgcagcaaagctcccgtccgcaaggaccgatacctccgatacgtcctgcttcctgtcgtgcaccgatttgtttcatttcaatacggacacggaaagcttcggcaagtaccttaatcagttggcggaagtccacacgttcgtcagcaatgtagtagaagatggccttattgccgtcgccctgatattccacatcaccgattttcatatccaggttcaggttcagtgcgatctggcgggcacggatcatggtcgcatgttcctttgctttcgcttcgttgaatttctccatatccaccggttttgctttccggtagattctctttatttcaacatcagtcttgaagttggccttcttcatttgcagcgggacgagtcttcccgtcagggtcacgacgccgatgtcatggcccggagcagcttctacggcaacgatgtctcccttttccagtttgatcttattgctgttgcggtaatagccttttcgggtgtttttaaattgcacttccaccatatcacactcttccgcgttgcctggtatgtctgccagccaatcgtaagtgttcagtttcttatcttgtcgggagcatcctttgcagcaaagaccgccgctcccattatgaagcttatattccatagtttatatatttattattgcttcaacagtacgatcatcttcagagagaagtcgaaaaataccatcttggcatttacattttgttctatatgcagttgcgcttcgcttagttcatccatgatgcctattacgttcctttcgttgacgaaaggagcaaagcgagaggcgaaattctgttcgttgattgtcatgtatgtcagatcacgctgatggagattgaatataaagttttcgcggatcatgcgctggcagtattccagaaagttcttctggcgttcacgtcccatgccggcaacctgttcgctccagagcttcatttccctgattttccgttgataggacaatcgcatcaggctgacaaataagtcgaagaagagctgattctcttcattcagatgaatagtttccagtgctttgataaagttcccgtttgccagatgggcaatggaaaggctgtcggcaggctggataccgtatttggactgcaatacgcggtcgatggccggttcgtctatttttcgcacgttcatgcgttgagtacggctcagaatagtaggcagaatcatttccggagcttccgatacgagcaggaagatagttttctcaggtggctcttcgagcaatttcaataatttgttggcacataccggatacatcttttcgggcaaccagagaatcgtgatcttgaatcctccttcgctcgatttgaggctgagtttcttcaggatttcatcgctctcttttgcgtagatgatggcctgtgcattctcggcatccatttctctcagccagtgattcaggttgaagtacggattcttcagaacgaatggtctccagtcggcgatatagtcgtcgcacacttcccgttttcctttagaacttttcacgatggggaatacgaaatgtacgtccggatgtaccagtttattgaatttcacacacgacggacatactccgcaggcatccgtctcaccccggttggtgcaactgatgtagcgggcataagcgatagccagcggcatcttaccgactccttcggggccacagatcagttgggcatgcggtatgcgcccttcactcacttcctgaatgagtcgttgcttgatttcttcttgtccgattacgtctctgaaaaacatatcaataaatgattttagccacttctttgatactgtccactgctccgatggagtagaagtggatgcttggcactccatgtgccattaactctttgcattgggcgacacaccattcgataccaacctgttcggcttccttgtcgttcttgcatttcaaagcctccttgaccaaatcttccggcaagtctactttgaatgtcttgggcaccatgctgagttgagataacttcttgaatggcttgatgcccggaatgataggtacattgatacctgctgccttcgcttgctctacaaattcgaagtatttcttattgtcgtagaataactgtgtcacagcatattccgcacctgcttctactttctttttcagccagaagagatcggattcgatgttgggagcctcctcgtgcttctccggatagcaagccacaccgtaggagaacgggctgttggttactttcatctccgaaccgtctacaaagattcccttattgaagttattgatttgctcctgcaactcgatagcatgatggtatccgtcgccctcgggagtgaatactgattcatgtttggccttatctccccgaagtaccagcagatcggtgatattgaggaattgcaggtcgagcagtacatattcggtttcttcacgggtgaagccgctgcacagtatgtgcggaaccaccgttatattatacttgttctggatagcggcagctacggcaacagtccccgggcgtcttctcagccggtttcgctggaaaagtccgttgcccagatccttatatacgtattcgctgcgatgcgtggtgatattgatatatttcggatcaaactcccgaagggtatcgacagtctgatacagcttttcgatgcctgtacctttcagtggaggaaggatttcgaaagagaaagctgttttttcgctgttatgtattaaatcaattactctcattctttttcgttgatgttcgttgtctacttgaattaaaagtgcatattgggacaaaaatacgaaaaaagaaagatttcttcttgatttgtttgaaaatagtttggtttttatcgcactattacataaaagtggggatggataaaataaaacggacccttatttagagtgttccaggaaattctccagagcggcgatcttgtcattccgcagatattgcatatccatgaccggaatgtagctgtaagggataaactgtaacaatctcactgctgcgaatttcttgtcagccgacatgaggacatccagccgaagatttccgcctgttcctttctcaatattgatattgttagaaaaattgcctgattcgatcatttctttcaatggttcaaggtatttcagattgaaagaatagttcttctctttgaccacgcttttagtcagcagatatctcatttccctggaacggaatttaagttggtatatgccaagcagacagagtaatatattgccgataagatataatatgctatctaaagaaatgccgtccataatgaggaggatcgcttcaggtaagtgacataatcctattaataaaacaataactccgatgattgttttttttacgttgaatcgttgtctgatatcctgattggatgaactatcagttcttgataattgatttgccatagtcttttctttttatactctttatacctattttctatgcacttatgattaagtgtggttgcaaatgtaggaggaatcaactgaaatgcggtgttccattcaggacgaaaattgttcaaaaggagactaaaggagtataaacttcggggtcgttttcgcatatatttgtgaaaaaaggcaatcttgaagagagaatgttttgatattctctttttaagactgcctttcgctcattctctgacgagtcggaaattacttgtcgagaaatgattttttcattctggcaatgtcagtcaggtaatcctgaagatcttgttcatgctcttcttcttcagcaaggatatgcttggcaatgtcgcaagtagtgaaatcttttccattggtaaagtcagcaatttcctgataacgcagtattgcgcaacgctcagaagctacattatcttttagcagacttacagaatcaaacccttggggagcatcatatttgcatcttgccagttcgaaccatttcttcgggtccaatacgggtactccttccagttcgataatgcggtcggcaagcagttgcgcatgtctgcgttcttcttccgcatgttcttcgaattcgccttgtacatctgcacgcatggcgccttctactactaatgcacctacccagtattggtaatatgccaaccattcttcggacaatgctgcattcaactgtgaaatcaagctttctacatcaagctttccttgtaagatttttacgctttctctagccataatttaaaagtttaggttactatattcaagtcgggtatgtaacagacgggagatgtttttgtttgagagttagcagtgatttaacagtgattttatatatgcatggtatgcaagcgttgaaatgagatttctcctgtaatatataagtgtacaagatagaaaaatgccaatatggcagatagattgattgatttaggggtggatgttcgtgtgccatttggtattcttttttttgtgttcggtaaccgggaatgcttgcttcatgctgaatcaagcacaaccggtttgctaagacaaatgattgaagcatcaatagcaggcaaataataagagtagattcaaggcgagtatattttctgcttactatgaattaaacacgtgttttgctcccatgctctcactttttgcttgtatcgtcttattcatcgttgttacagctgttgtagcaagtgttgtagcagtgtgggagcaggcatttgctctcactctatatccatgctttaatacactttttacttgatgttgtggtttgatattcagcgtgttaatgtctgatagcccctcttttgttgtctgtactgtattggatttagttgacaacctcgatgaagcgttagtttcctcggaggaaacggcagttccctttaaaaggaacggtcgtttccattaaaaggaacgcccgttccctcaccgggaaacgacagtttccattccaagaaatgataggaaactataagttattgatgtgtactggttttagttgacaacttcgtttgttataactgaattagtttactcaatatactttaatatctaaataggtttacttttgttattcttattcctatgttagttgtcttttgttggttttttgaatctatcttgatcataatattatttacaatttaatcatttacaatttactatttagcaagcaccgccacaaaggagtgatttcacgaagaataccactactacgagtgcgaaaccgagtactacaatcgtagaatagatgttagaaatacatttccaacgattgatccataccttgttgttccatcccagtgattgcatggagctccagaaaccgtgagtcaggtggaaccacagagcaaacagccaaatgaggtagagcactacataaaccggacaagagaatgtctgctggatgtgatatgcaccgtttgccgcataagccagcgtcagtgtatcagcgtgcatgtccaggttgtgcatcagttccggcaactgcatttttgcccagaagttgaagaggtgcaaaccgaggcctacgataacgataatgcctaacaccaacatgttttgagaagcccactctacagttttcggtttgtcgactactgcatagcgttcgctaccgcgcgctgtgcgattctgcattgtcagccagaacgcgtagatgatgtgaataatgaaaagagcagccagtgctgcggtagctaccagcgcataccagtttgctcccaaaaactcacaaatcatgttgtaaccatcagccgagatgattgcaactaagttcatcgccatgtgaaatgttagaaacaggacaagggcgataccggtaacgctcatcaccactttccttcctacagatgaattacttaaccacataaatgattgaatttaaattatttaattgttagaactaaaatttcgacgttttacacctcttacagactgcaaaaataggggaaatagattgattgaccaaagaattaaagaaataattccttaatcggtgatctttccgattttttcgccattggccgctttcttgcgcaaggcgcgcggggtgtctccgaaggagtctttgcagaagtgtgcaaggtgggacagcgagtcgaaaccataccggttgcaaatctctgtaatccgcatattagagtgctgtaggtcttcgaggatgccttcccgttttttctccagcatccattcgtagacgggcacgccgtataagtttcggaagagacggcggaaggtggtggtgttatagcctcccagatgtgcgaattcttcgacgttcttcgctttgctgtaattctgcatgacaaagtattggaaactttccgtataggtgctgatcgggtagaagaaagccctcaactggggcaggggatagtaattggtgatcatatacaccatctcctgacatttcaggtcgatatatttgccgcaggcgggtgtcgattcgtcaaggtatgcggctacgtcgttgatgagatagaacaggcgcgggttcatcaccattggggtgtaggtcagcgggccttctgcctggtcgatgatttcacggtagcggttttcgcatagcaacggcagttcgttgaaccagaaaaggatgtatgatacgtccgtcagtgccagtatctcgtattttgagccgatggcttgcaggataaactgtttctcgtgtagtgtcgttccgggatgttcgtcactgttgatcagcaattcgccctcgatcataaagagcatgcagttttgcgtgcacttatccttcggaatatgctgccctctgagcagatttctgtgaataagagtactttccatcgctttggggcatcctgagcaatctgtatgttgagcacaaagtgagtcttttgacatgggttttatccgtgaatcgttgtctacagggacaaagatagtcgttttttgtgaaaataaaattctttcttccattatgttttagcagaaacggggatatgattgtctttattggttttgtttgcacaactttgaagtttcacggactcctgaatggcgttctttaatacatttttatctgccatctgcagcattttcttcatccctttacatgatatattcagaacaagtagtttcatcattagttccacctgttgaaaccaagtgtttcaaggcatgaaacaaactgtttcaagtaatgaaacttcttggaacaactgtcgatttcgttcatatgacagctcgattcaactcacttgaccgcataagttgctctgattgacctgtccgttcgaaaggtattatttcatttttcagtcaataatggatgacttctcagctgttaatacctgatttctcaattattaatagctgacatgacaatcgttaatagctgacgcgtcagatgttaatacccagtaaatcaaagtataatgtaggataaacgacctatatgccgtggtggcagagtgagagcaaacctttgctctcactctgccaccatacttgctgtaatgcttgaaatgccgatgaataaagggatacacgcgaataatgagagcgttagggcaaaactgctatctttttcacttgtagcagctgcctaagttcaagttataaatgcgacagttcagtttccgtaccagtcacttacttattatagtatttttcaagcagtttctgcatttccggatatttctcgtccgtatctccggtttctttgcgaagtctcaataagtctttcttcatctgtttgatgacaggtgcatatttcggatcgttgtatgcattatgattctcgtgcggatcattctgtaagtcatagaagtcccatgacggagtaaagtcaaagttctccgtatcagtcatgtctagatttcgggcataatagaagatcagcttgtaacggtctgaccggatggcgaagtgcgcgggacgaatagcatgattggtccagtagcgatagtagatttcttttcgccagtcggtcggcgtgttgccttccaggttgctgacgaagctgtctccttgcacattctccatctttactccggcaaattctgccagcgtcggtgcgaaatcgacattcagtatcagatcgtccagacgttttcctgcgggtaccttcttcggataacggataacgaaaggcatacgagccgattcttcataaaacatccgtttgtcgaagaagccgtgttcgcctaggaaatagccttggtcggagacgtagatgacgatggtattgtcggcgatattcatttcgtccagagcgtttaggagtttgccgatgttgtcgtcgacggtagcgccgcaacggaggtagtcacggataaacttttggtaggaagcacgtctggcggccgtccgttgcatcccttcggtgctgaacggcagtccggggtagcgacaccaccacttgtcggggtcctgtgatgcgatgcgccagcggcgttccagctcttccagtgtctgtcctttgaaagaacggccgttggtttccggtccccagtccagcaggttttcgggttcggggaaggtgacgccgtcgtagagatgctccatgcgtatcgggtagtcgtagggttcgtgcgttgctttgaaatggcagcacatcaggaagggttggttgccgtcctgctctttcatccatcggatggctttctcggtgacgaggtcggtggagaagccgagcacccgttcgccgaactggtggttgccgggccacgggtcggtgctctctatgaaagtcgggtcacggtattcgccttgatcgtagaagatggagtagtagtcgaatccttgcggttgcgactggatatgccatttgccgacgagtccggtgtggtatccgttggcttgtagcagggtggcaagggtggggatggaggtgtccagtgagtccgcaagggtgtacagtctgttccggtgactgtatagaccggtgaggatactggcacggctgggtgctgagatagagttggtgcagaaacagttgtcgagcactaccccttcttttgccagccggcggatgttggcgttgtgggcatattctgccagtactccgccatagatgccccaggcttgggaggtgtggtcgtcactcaggataaaaaggatgttggggcgttgtccggcaggttgagcgccttgcaggtgcgtcatggttccggctgccagcagaccggtaagtacgagtttattcatatacgtatagatgttgcatttcttcaaaagtcagtctaagttagacggttgctttcatgtagataaatgatcatatgaactgattttatgcctaaagatagtgattgttattcactttgtattataatccggaaaacttttgcgatttaatgtaattgattccggtaaaacacttaattccctttttaaaaggatgtttttgttttacatctctcaataagaaactttatgttgatttttggaagtattatagtgatttttgaacatttgttttctttgcctgtacctacttttgcgatcaaaacccattaattatcaattattatgctactaccaagaaaaattgtatttttccttctcttgtttgtcggattatcgttgtatgcgcaacaaaactgcttcattagttcgtatgtacggggtaatttctacaatcgcggacgtatttctgccgagagtttaagggcgagtgatgatttgatttttctgaacgtccgtcccaataaagacgggtcgctttcgtttgagaatccccgtatctttgagaatgggaaaggagtgactagttgggaggaattgataaagtctgtccgtgcggatgtgaaaggaacaaagacaaaacttcgtctgggcgctgccagtggcgagtggaaagcgatggttgcagatgaggcggcccgtgttgcatttgccaaaaacataaagaagatactggaaaagaataagctcgatggcatcgatctggattttgaatgggcggagactgaaaaagagtatgaagattacagtctggctattctgaagatgagagaggtattgggagataaatatgtgttcagcgtatccctgcatcctgtgtgttataagattagtaaagaggcgattgctgcggtcgatttcatttcttatcagtgttacggtccttcgccggttcgcttcccgatggagaaatactgttcggatatacagatggcgttggcttatggcattccaaaggaaaagctggtggcaggcgttcctttctatggcgtgacaaaagatggctcaaagaagactgaggcttacttcagttttgtgcaggacgggctgattacggggccggcacaaaacgaagtaacctataaaggagacgtgtatgtctttgacgggcaaaataatatccgtgccaagacacgttatgcgatggaccagcagctcaaaggaatgatgagctgggacttggctacggatatgccgctgaatgacagcagatcgttgtttaagacgatggtggaggagttggggaggtgaactgcttcagataatctgaaggagagacaccaaactcatccttaaaacattgacggaagtagcctgtactgttcattcctattttataggctatttccgagatattatattttccttcgaggagtaaccgttccgcattctgcatttttactttccggatgtactcgttcgtagaaagtccggtcagtgctttcattttccggtagagcgtagaaccgctcatacacatcttgtcggacagataagtgatgtcgatcttttccgaagaaaggttatcctcaaccagttgcgtgattttctcaatgaattcgttatccagtttgctgagcgcctcggtgattatggaacgcttttcatccaaatgagaattggggttatgattcgttccggtctgctggaattgagcaatcagtttctttctcgaatcaagcagattgttgatgcggcttcgcagcagtgaagcactgaaaggcttggtcagataagaatccgctcccacttcgtatccttcttctttatcctgcaatgaatctttggccgttagcaggatgacagggatgtggctggtacgcacatcctcttttagttgacggcatagcgtgatgccatccattaccggcatcatgatatcgcttactataatatcgggaatacggttgagagcctgctgtttcccttcctcaccgttgctgcctgtgattacttcgaaagagtcggagaaagattcggcgatgtatttctgtatatcttcattgtcttctacaatcagcaggataggtttgctcgtttccggttccgtattttgagaatcttccggaacagcttctgatatcatttcctcctctgtttgcttcgtagagtctccatgcaaagcgttggggtagatattgtctgttaataagctgatatagaaagtacttccttcgttctgtatgctttccacccggatttcgccttcgtgcagttctacaagatttcggactaaagccagtccgatacctgtgccggatgcctgatgcttgccgctttcctgatagtaacggtcgaaaacatgaggcaaggcttccgcagagattccgtatcccgtatcactgactttaatctccgtataagtgaccccgtttcgtgtggtgggatacaagctcaaggttatttttccctgttccgtatatttgatggcattggaaatcagattatcaaggataatggtgatgatttctttgtcaaagaacagaggcatctcttctttttctatttgaatctgaaagtcaatcgctttcttttggttgagttctttgtatttgagtccgatttcatgaatcaggggcacaatgttgcctttacaaacacatagctttttgttctgcgtttccgttttccggaactcaagaatctgattgatcaggttgagcagccggagggcactcaggtggatgacagaaagtttctgcgcctgtctggtcggcagtgacgtgtctttctgcatatcttccagcggaccgaggatcagggtcagtggtgtgcgcagctcatgagtgatgttagtatagaatcgcaggcgttcctgattcaattcttgttcttgttcgtggtttttcttttccagggtatagagactttcgaggtctattttcttcttataggcatggataatagtataaataatgctgatagtgatcagaatataaataagttttgcccaccatgtcagccagagaggagggttgatatgtatcctgagagaggtcgtgtcctccgaccagtcctgattgtgcaggcgggcttttaccagaaactcatacttgccgggaggaatattacggaaggtgacgctgttttgctcgttgatcgtataccatgagttttcaagtcctttcagcatataggcatattccacctggttggccagtgaatagtcctgtacgttgaaagtaagattaaaactattttgttcatgagtcaattctatctctccttcggagatgggaatagcggtttcgttcttctcccgacttgtgagtcgtccgggaattctcactttagtgataaccacaggaggaatctgcggactgtttatggcaatatcggggttgaagaaacacaatccgttgatagagccgaaatagatgagcccgttatggtctttggtaacgcatccgctgatgaaacttccttgtgggatgttgttggagtgatcgtaggtatagaaacattttttagaggtgatatagcaactgataccggtattggtacttgcccagatgttgccgttcttatcttcactgatagctcttatgtgtgtattgggcagtccttcttttctttgaaaaacctgatagtcaaaattacgggctgaaggaaaacataccagtccctcaccggtggcaagccacatctggcctttgctgcttcggtatatctgattaatcgtattggaacaaaaaccttcgtattggttgaacttcctgaccagttgcatatccggcgtatatatcccgactcctcctccgaaagttcctatccagaaacgtccttcactgtcttgggcaatgctgcgtacaaagttttccagcaactggctgttggaggtgtcataatgatgaatcaccttcttgctggcaaggtctataacgaacacccctgcgtgagtccctatccatatctttttattcttgtcttcatagaagacgcgtacgtcgagaagctcattcttttccagttcgatgatctgaaacttcttcagtcttgtattgtaatagctgatgttgcccagataggtgccgaaccataggttgccttccgagtctttcagcgaacaaagcactgagttggacaggagttctctgttttctttattgtaaatggccacccgttttccgttttcgaatacgttaatacctcctccgtcagttcctatccacaattttccttgtccgtcatcgcagacgctgctaacgactttgttgctcagcgaactttcattcatttgggtgggtgaatagctccatgtatggaatgtgggaggagcattgctgataaaattgattcctcctccccaagtccctatccagatattattaaaagagtcttgaaagatataccgtgcgctggcgttggacaaactgtagttattgtccccttcgcggataaactcaaagcgtatttgttcgggcagcagaaactgattttgctgtaagtccagtatcatgattccgttcagttctgttgcaatccagagtttgttgtctttgagttgtttgatggagaagatatagcttgacaatgctccgtgaatattccccgggttgttatgaaagttggtaaatgtttctgtattggcattgaacagggctagtcctttgctggttccgatccatatatttccgttggtatctttatagatacaacgcacatcgttccccggaaggctgttcgggttttgaggatcatggacgaagtgcttcacggatttgtcattcagggagaggatgctcaacccgccttctacgtgtccgatgtatagtttgccatcctcagcctccgtggctgtccaggtctgctcagagggaagggcgggtactgtgcttttgttataatgagtgaatttcccggtagcgatgtccagatactctatacctctgtaataagtacatacccataaccctttgccggcttgtacggatgaggtaatgtgagtgacatcgttcgttatcagactttgcgggtcttccggattatattggtagacgctgaaactttgtgtctcgtaattataagcgttgagtcctgcccgctgggtggctatccagataacaggctgcacgggatcggtgtacacttcattgagttcgttgccggtaatgctttgaacagaagaagattgctcctctttatagtaggtgataaagcgggttccgtcaaacttattcagcccttcttcggtggcgaaccacagaaatccctgcttgtcctgcgtgatactcaatacataattgttggataagccttgttctattcccaatctttggatgaggtaagggtgggctgccacaaatgtggcggatagcaggaggaagaaagccgcaatgtatgttttcatcgtttcagatattatgtattccttgatattcactctcaaaagtacaaataaatcttgtatttagtatagacaaatgattcattgcatgattttctaccctttctgcatgatttttacagcgaataaaataaaacaactgtaattttgcaatcaatcaaataaccgaatctaatacttgcagaaaatggaatctgattctttacacgaacatgataaaagctggaaggcattttttattaccactctgttcatcttgtgtacagcgaacgtttatgcgcagtcatccgatacaatcttttcccgatatttccgttatgcgcagaacttcgcagatgcgtaccctcgcgagaaagtgagtcttcatttggataatgcaagttattaccttggtgatacgatttggttcaaagcgtatgtagtgacggctgaacaaaacttaccgacgacgatcagcaaacctttgtatgtagaattactggaccagttgggaaatgtcgtagagcggcaaattattcagcttacggatggggagggaacgggacaaatcattttgaacaataccttctttaccggttattatgaaatgcgtgcctatacaaagtggatgcttgcttttgataacccttcctgtttttcccgtgtattacccgtctatcggaaacggctgagcgatgaagagactcctcggagtatagctacctatcgtatggacgcttcgatgaaacagaggccgaaggataaagagaagaagtttacagtccgcttttttccggagggtggacaactggttaaaggcatatcttcgattgtagcttttgaagccaccagccgtgacaaaggagctgctgatgtagagggaacagtggttttgccgagtggtgaagaactggcgcatatccgttcattgcatgacgggatgggttactttgagtataagcccgaagaaaaggcgggtgtggcaaaaattgattatgaaggctccacttatcagtttgaccttccggaagctcttccacaaggatatgtactccgaatcgataaccggcgggaaatgttggatatcactgtagcccgcagttcacaggcaatgaaagacacactggctgtttttgtatcttctcaggggcgaccttacaaatgtatgacactggactttgaagatgaattgaactgccaattccggatttcgactaaagaactaccgcccggagtgcaacagatatctctggtcaatctgaaaggggaaacgttatgcgagcgtttttgttatgtgatgccgcgttcttccatgctccttgcctgtaaaacggatcacgccctgtatcgtccttttgagccggtgacttgccggattaaagtgagagatcatctgaatcgtccggtacaggccaatctttctgtatctatccgcaacggtgtagagtctgattttcgggaatacgatcattccatttatacggatttgttgcttgtctccgatctgaaaggctatattcatcaacccggtttttattttgagaaccagtctgccgaacgtttcaaaatgttggatgtccttctgttggtacgtggctggcggaagtatgacctttcccgactgataggtaaacgtcctttcttgcctcggtatcttccggagacctcgctgaccctgtatggacaggtcgaatcttatttcggtaaggcgttacggaatgtcggggtgagtattcttgcgcgcagggattcggtctctattgcaggtatgacaaaaacggattcattggggtattttagtgcgccggtagatggttttagcggttctatggatgctctcatacagacacggaacgagggaaagaagtggaacaagcaggcagtcgtgaagttgttccgtaattttgagccttccttacggaagcttgattattatgagctgaatccggaatggaaagaggcgggtgatttgaaacagttgttggacaccttggatattgcttataaagattctgtattcggaccggatcatcatttgctggatgaagtggtggtgaacgccaagcgtctgaacttgttattgaagcaaactgaacgctttgaaaaagagattctgggttattataatataacgcaggtggtagataaaatgcgtgataaaggagaagcggtgtacaatctgcctatgctgttgaaggaattaaatcctaatttcagattgagtgattcgctgagcctgcactataataactcaagagttttatttatagtcaacggcggggttttatcttatggtaaaacggattatgtgttggacaaagatgtggatgctattaaatctatcatgctttattatgatcaggcagggggggaatctgtttttgtgatgaacaagcagagtaatagagtgacgaaatttacagcaaataatttttggagtggtcgctggcaggatggagatttgagtgatttgtctttgcaggatgctataggtgcggattccggaccagatgcactttggggtgagaaagatagaaagactatgaagaaaggtccgttgcagaaatcgtcagtagtagtttgctccatcactacgattgatgactgggacccgaacaaaacttataaagcccggcgcgggattcgtcatacctatatacaaggatataatgagcccttggaattttattcaccagcttatcctgatggtgctcctctctatacggaagattctcgccgcacactatactggaatccgaatgtgaaaacgaataaaaagggtgaagtagtcattcaatgctataactccgataattcggcaccgttaataataaatgtagagacattgtataaaggtagtccgtcatcattgaatatctactctatagattattaaactcgatctatattattcatattcatataaagtcctgttaaagaggaagaaaggagttgtgtttcttgcagccaacgtgtgtaaatcgtttatgaatgattctctacgttttttgaatgatttttataatgtaaaatctacactcactactatttcatctgtaaatatccatccgccaaactcttctccggcacgagcctgataacgtatataccgtccttcagcactgccttcccatgaaatactaataaatttaatagcttcttttctatttacttcaaaagtatattgtttcaattctgtgaagtttgctccatcatcagaaatggaaatagtgacagattcaggcaaaaagacctctgcccctaccacttgcataaaatcagcagagacagaatggacagcagtttccgtacccatatcaatggtaacatccaatcgctttttatcgataaaaccttgccaggatccatctccataagtccagtcgccacgaataccatcagtaagagctgtatttccctgcgcaggatagtgaggactatacggagcattataaatcacctttttccccacagccaaatgacttatcggcttcaaagactccggacgacttcctatctcatttttaagatcaaaagtatgatatcctttcgcttgcaaatcatcaactgctttcaatgcacgattatgaaagtctgtccatgatttacgttcggaagccgaccaagccacttctgccaaagcaaggatacgaggatatatcatatattccatatgctccggagtggggatatattctgcccatagatttgcctgcacaccataaacaagttttgcctgttctacagttaaagaatctgaaaccggattatatgaataaaccttctccaatggcaaatatcctccgatggcttccggctgagaatacggagcatcctgataactatccaaataacaatattgaccgggagtcataattgcctgatgaccggaacggacagcagcaatacctccctcttcgccacgccatgacattacagtagcattaggagccagaccaccttgaagaatttcatcccaacccagcaacttacgtccatgtgcattcagaaacagttcaatacgatgaatcagatagctttgtagctcgtctacattagaaagatgttcatcctgcatccttttctgacatttcggacaagtcttccaagccgccttaccagcctcatcgcctcctacatgaatatattccgatggaaaaagctccattacttcagtaagcacattttctaagaaagtgaatgtttcttcatttccaacacaaaaatctgcgtttttataaggttcacccgaacaggagagttgcggataagcagccaatacttcttctgaatgagcaggcatctcgatttcaggaatgattgtgatataatgctgctgcgcatatgcaataatctccttcatgtcatcctgagtataataaccaccggaagcaccgggctcatcaaaacggagatatttccgtccgccattccaccacttcttccagttggcatcagtacgccaggcggcaaattccgtcaataaaggatatttctttatttcaagtctccatcctgccgcatccgtcaaatgcaaatgcaaacggtttagtttataaaatgccaatgcgtctatctgtttcttcacaaattctttagagaagaagtggcgggagacatccagcatcatcccacgataagcaaaacgaggggtatcctgtacttcaacagaaactatagaataacccgtgcccgaaagctgagataattgcaacagtgtctgaattccataaaacaacccagcaccggaagaagcctgaatcagaatatgtttaggagtaacggataatatataactttccggtgacaccaactgaggattcttttctgttatcaataaagacaagacattctgtttatctttctttttcccttccttaaattgtacaggtaatgcagttttcagatagtcgcccagaagaatagcttcttctccttgtaagtttgtataaagctttgttttttcagagagtaaaaaagagcccgtaccctgttccatctttaagggaacaggaattacggactgtgcattaatgggatgtgcacaaagacacatcccgattacccataagaaaagacaaactttagtgtatctctttcttatattcattaattaattgtgatttcgtctacaaataaaaagcctggataactcttaccaccatgccattccggaatacttttctcgggtgaagctataactttcacatattgtgcagttacaggtgtaaatgttagtttatggtcataaacaccatttttatcagtttccttcattgcaggataagcttcagatgccactttcgtgaagtttgtgccgtcttctgaaacttctacagagagtccccttgtatcaaaaacccaatctcccttctctacgcaagtagaaatggcaacgcttgaaatctctgttggttgtttgagatcaatagtcacatccatatcatttcctctaaatgcaatccagcgtccggttttatagttaccatttcctttcaagccatctaccaacgtagagacacctttgaactcatattgtttattcaccggctgattagcaacaatcggcttcatgcttgatttactgaaatcgattttctcagaaacgacacgactatttccagtagggcgaatagctatagccgagaagtctgcattttccttaatcttcaaagcgccatcataaacgggagaagtactagtcggctctgtaccatctagcgtgtagtggattggcgcattgtcaattgtagtaagtgtaatgtctaaagtaccatcagccggattcggagtaaattctgcttttacgtcaaatacgtgctttgcataattatatccttctgcatcataccacttaatcagtcgtggaagacgagataagaaatcttcgtagttcttcttatcaggtgttgaccactggacttcacacaaagcagcccaacgaggcaagaccatatattgagcatgagagaaagtagcaatatattctgtccagagattagcctgtacaccttttatatactgctgttcatccggagtaagggaagccggcatcggctcatagctgtacaccctttccatcggcaaataacctccgataccgaaaggttcattctcagtatctttagcctgataataatcaaaatacagataagtgttcggggtcatgatcacatcatgtttctgcttggcagcttcaatacctccactttcgccacgccatgacataactgttgcattaggagcaagtccgccttcgagaatctcatcccaaccgataatctgacgtccgtgatcgttcaggaacttctctatatgattgataacgaaactctgcaaacgttcttccttactatgattcttatccgatttcaagcccaacgctttgatacgtgcctgacatttcggacatttctcccatcttaccttcggacattcgtcaccacctacatggatatactctgaagggaagatttcaatcaattcgccatatacatcttccaggaatttcagaacctgatcgttgccggcacaaagtacatcatcggctactccccattgtctccaaacttcatacggtccaccggtacaacccaattccggataagcggcaagggcagccagcatgtgtcccggaaggtcaatctcaggaacaacagtgatataacgttctgcggcataatctacaatttccttagcctgttcctgtgtatagaatccaccatagggtgtattgtcatattcaccggagttacgtccgatgaccgttcccgatctttgagaacctatttccgtcaacttcggatatttcttgatttccagacgccatccctgatcgtcagtgatatgccagtgcaaacggttcatgttgtgcaaagccagcatatcaatataagtcttcacttcatcaattgtgaagaaatgacgactaacatcgaaatgtgcaccacgataaccgaaacgaggagcatccttaatttcaacagcaggcaatgctacatcagcacccaaagcaataggcaatgatttacgcaaagtctgaataccatagaaaactccggcttctgtaggggcagttatcgtgacaccttgatcggtgactttcaactgataagattcagggttttctacttctgagcctaacgccagcactatagcatttttaccttcagttccggcttcaatcgaaaagtcttttccggttgcagtcttcagataatcagccaaaaattgcgcattacgctgcatcttctcatttccttccggataaaggattttcacaccgcttttcaaaataaaggggtttacttgcgatgttacaatttcttgtggcaatgggataatctgataattggcttcttcttgtaccgagccacaagagctcatcagtcctgccagtgccacacatcctgttaattttaggagttgtttcataaaataaaaattaggtgttagtagttaataaattagttttatttataggtttctcgaatatgcttgatattgacaggtaattcttctcccttctttatccggggagaagtgataattactttcttacgttctccgggtaagagatcaaagaagttgtcactgtaacgggctccttgcaatggagtctcaataaaaatatcttttgccaacattgatgaaaagagagtcaattcacatttaccatccgtctgcttcatttgataggatactgatgtcggaggaagttgcaaatctttcgtctttctgaaaaaatggacgctctcagccacctgatgtcccgatttatctttgagtatcaatttcaagaagctacgtcggcagtcttcgggagtcagccagccatccagttttgcacgataaacacattttgaagtatttgccggaacttccaacgaatgtacttgtatcttcttacccagcgtttttccatcaaaatccacgactttcatttccaatgtcatttgctccattgtatcaagccggtctgagatcagatagacactcaaactgtcattctgctgtataggattgatcaagaccggtgcaaaagcacgctttgcctgataatgtaatgccttccaattaccataataatcaatacttgaccaggatactaccggccaactgtcgttcaactgccaatacaatgtccccatacaataaggacgattgcgtctgtgagcttccagtccatgccgcatcccctgtccttgcaagactaatccgacatacacaaaatcctcgaaactttcgggaatgatataatcacgttccatataagtacggatcaacgaattaccaatactactcttctgatgcgcattcatcacttcagactcaatctgataatcttcaggagcagcaaaagcagcaatagttttcatctccggaaatgactggaaaccaaattcactcataaaacgcggcaaatcggtatctaaagactcaaatggcttctttccgtaccagactccccaattatgactgtctcctgtcccccatgactccggacgcccccagttagcgagataaggcgaactgtgcacataaaaacgatccgaatcaaattctttaaccgttgaaggcaacagctcacggaacagtttatcataaccatgcattaatccttgataaacctccggagtaaacttcttctcaaaaccccaatatttcagagcttccagtatttcattattaccacaccacatcgccaaagaggcatgattccgaagacgacgaatattgtaaacagcctccgcctctacccgtttcaggaaagtaggatcggatggataaggggtacacgcaaacataaaatcctgccagacaagtatcccgttctcatcggcaaggtcatagaaaagattattctcatatgtcccaccaccccatatacgaaccatattcatattggcctccttcatgtcacggaacaaagtctgatagcgttccgtagtaacattaggcagcagtgcatcctgaggaatataattagctcctttggcaaacatcggtatgccattgacttcaaaataaaaagattctccgtccttatctttttcatttaccacacgaatcgttcgtaaaccaatccgatgagattgttccgcaacaatccgatctccacaagctatctgagccgagaaatcatacagagtcggagttccccaaccatttggcatccatcgtacagggttcgtcacttcagcaggaagagtgatatgatttatcccgggttgcagtgtcacctgctgttttacttctgtaacggtagttccattcaacgatacattgacccttacttcagccggaattttctgaggaacgatctggtttacaatcagctcattagacagacgagcgttttcatctgtcagcgataattgtctgacatagtagtcggatatggtagctatgtcgtaaaaacgaagagtaaccgggcgccagacaccacttgtcaccattcggatgccccagtcccaaccgtaactatacggagccttacggctgaacacactaagatgtttctcgtgatgatcgttatccgccggataattgaagccattggaagcatattgtggcaacgtttgccgaataggtgaatggaaataaatatataagtgattctcgcccttccgcaacacagattttacaggaagtgtataacccacaaacatattatcagccttcagcagtaatgagccgttgagatatacgtctgcataggtatcaagaccttcaaaaataagttggattccgtcacgattcaattgctcttcggagactataaaggaggttctatattcccagtcctcattctccacccattgaattttcttttcattcatcccataaaaaggattcggcagtaattcatgactgatcaggtcctgatgaaccgtaccaggaaccgtggctggcatccacttttcagtccctgattgagaaaattcccaaccggtatccagtagcatgacttccgaagtgtcattaccttgagcataaaccatactacagcaacatagcaatccacatgctatcggggctatctttcctgtcaaatttaagatcatagtgggggcattagatattaacggagtaaagatattgcttttttgttaaatatttcctattgaagctacaaaatatctcatttcatcgaaaattcggcacgaaatgtcgaagcaggcagtccttcccgattgatcagattagcccgcgtaaaaggttgccagccataacgtacatagcggggatttggcacttctttactatacaccttcacctggtctcctacaacctcagccgttgccggataatagataccatcatattccgctacttcaaagcattgtaaaggctttccgtctgaactccgcatcccttttccataatcaaaagataaaaagactttcccaccgcgaacgtttgcaccacgaaataaaggaccggaaggaatgacatttttctgatacgttttattcaaagcccctcgcgccaaacgctctcccacaggtttcttacagataggatgcacatccagagaatcaccatgatcgctggatacagccattccgatatgagaaatttcattcaacattctacgctgactatcacggaaccaaggccaggaagggcgattcaaactggataattgtacataataaaaaggcaggcaggcatcattccaattcttccgccaactattcacgagcagtttaaataatttttcatgagcttcccaattatgtgcattcgattctccctgataccagattactcctcgtatcggatactgttccaaaggccgaatccccgactcatataaataacaaggctcatacggatgcctctgctggctatttgctgacttttttatattcaaagcagcccgtccgcgcacccattcctgaataaaatcatttttagtccagtcttttaaaatggcgggaaactgatattccaaactagctctatctacccaggcttctgtaggtgatcctccaacggcattgcaaatcaatccaaccggaacattcagactatctcttagcatcttaccaaaatagtatgcaattgccgagaaatcagaagctgtcgccggagtacaatttttccattccgtatccttataatattggagatgattcaacgaatcaagtacgttcgcctcccattcgacggcatttgtgcgccaacgtgctttcatatcatacaaacgaagttgctgatctacggcacgtggaatatcggctcgggcagtcgaagcctgtttcagcataaactccatatttgactgaccggaacaaagccagacttcacccgctaacacattttgatattgaaaacccgtctcatccgttgagatctttaaggtataaggaccacccgcctttaaaggaggcagcgttaccgaccattttccattcagacctgcttttgttttcatttgccggtcggctatgcttacagtaacccggtccccggcattggcaattccttgaaccgtcagcggaacatcccgttgcaataccatattgtctgtataaagcaacgacattttcagtccgccataatctccggtaatggcggaatatacggtctgagccataataaacgctccttcgggatcagggtgtacggcgtccgtcaatatgaaagggtatggatacaacggctcatgaaagtcgatcaactgtactccggtatagcgtgccacattctcaatagccaattgtatttctccatgccagtcacgtgtccctgacaggaaacgaggatgccgatcggcaataggcgtaagtctggcaatcataatccggactttagaattagccgcccgaaaagaatcgatcaattcaatgtaatctttcacaaagaaatcacgataatcggaccaatcacggggatctgtatcattgatgcccaaatgaataaccacaatatctccgccaaagtcgatcgctctgcgatactcatcttgctgcatataaggccggtgccctttattcaacaaggtagcacccgatttgccgaagttttcgacttgataagactctcccaacatcttctgtaattgcaccggatacgattgtgtagtccggtcgggcaatccataaccataggtgatactattcccgatgcaggcaactttaatacgattttcctgtgcactcgctgctgtaataaacaagatggaaacaacaatcaataatacatttttcatcatataaaagtcaattacattttcttttccggagaatagatcagcccttctacggccttatcgccgtcaggagtcacaaatactgcagtaaacatccatttaaccaatcgtacttcattcgttgagaatttgccgacaggcagtttcagcaataccttattccagcctttatgcaaatgaacccgtagtggcggacgtgccacacaattctcattacctaaggctgtttccgagcttttcacgagatgagtagcagaccataccgggggcagtatttcctgatcattaatccaaatacggctttctttataatcccactttcccggcaatggcggcaggtcattctctgaacgtccataattctgaaattcagcccataagcctacttcctgtgttttagaagaatagacatacgtgtaagcataagcagtatgattctcctgtggatctttgtaaaaagccggcacaatcttaccccatacgtgccgaagatagataccggctcctatggcaggacgcactccatattgcttcccttcataggtatatgaatctttcagctcttcttccggtggaaaaactttagtcagatccccctcatttggaaaagcatctgtaatgttccattttacatgagtctgtttgacataggcaaatggataccctttaaacagatgctctttataccataacatacgactttcgaagtcctcaaaattacgaaagacctcagagttttcatctacaggaagaattgttccctgcttatcgaaatattcagttcctcctccccgccatgaacgctctgcgatagccagcatattcgggtaaaagttattttccagaaccatattccactctttgtcgattaaacgatcgttccagatacccataatgactccggcaagatcatcacttcccatatctgcattataaatccgactattatatagagcaattatatcgccgaacgtatcaaaatgattcaaataatggaaacgggagtcaatagcgggaataccctgttgggctttgccacgataactccaaagttgcatcatgtcgatctcacccgccttatacttccatccgggattccaggaaatcacttttttccctttgtcacggacataagccaccatttcgggcacaaactgcggattagtaaaatgcacttcgtctgttccaatatggagatatggaacatcaaacgtttcacaaatctcatccagcaggagtttcaggattttcattccttccggactttgcatatcatgacggaaagtacggataaatgccgcactatgcccgggcatatcaatctccggaatcaacagtacctgatgagctttacagaactcggtcaactctctggcttcctccaacgtgtaatacttacccgccatacgagtcatattcgtactgtcattcagcatcggaaagattttactctccagacgccatgcctgattttccgtcaagtgccaatgaaaggtattgattttaaatcgggataatatggctatctcacgtttcaattcttccaaagacaagtagctacgccctacatcctgcatgaaaccccgaatccggaaagccggccaatcagtgatagtagcacattgcaggcggttcttctttcccttttcttcttttagttgatatagcgtctgcatcgcccaatatactccgcgctctgctacagcctccacagtaattgcctttggagtaatagtcagacgataagcctcttccttattgacagatacattgtcaatcgcgtcaaccaattttatattgatagaggatgccgactgatcagtcagagtacctcccatctccgtcacaaactgtttccattcctgcgaaagcacaggagtggaaagctgcattttacccacgataaaatatccttttgcaagcacacattgctgaggttggggaagcagacgcaaatgatctgcccccaatatatataaggtatggaataaaaatgcaatccccaaaaagattcgaagacttttcatcgaatcaaatctttcagttttacagcttgaaatgtcatgtgggctgcactactctcatacaagataccaatcgtttcccgatcaatcattgtcagacagctatatccccagccttctccttcatccagcattaactgatgttcgggaagccaggtcagcccatcgtccaggctagctttaatagttatatgattgcgtcctctggtcgtattcggattcgagaacaaaagaatatctttatcaagtacattatcttcagcttccacatggatcaaactagccatacatacaggttcctgcaaggccttccgagaggaaggatgttctgtccatgtcttgcccagatcttttgtaattgccacagcacggcttcctccacggttatcccgcatattcagcatcagcactccgggctctgtttctactacttgcgcttcggttgtattggtgcgtgccatgttgtgcatcttccatgtttttccgcggtctttactatacatgataccggcattaggtacacgggtagagtcgataaactgagtagggaatactaaagttccatcactcattgttattccccgtcccggtccctgaagcaagaaataccaggaagggtcttttacttgttcggttatattaatcggtttcgaccaggttttaccgtcatccgtactttttgccatcaccagttgtgccgtttgatatagatccattccgggatgagaactccaccaggcacgttgattacccattccgtgtgtccatgcggcaacaacccaaattgtattcgtttgggtatctaccaaaatagaagggtcccctactccattctgtgcagcaggcaaaccatcgtattcaccgaacgaaagaggaaggcgcatcttttcccatgttttgccaccatccgtgctccggctcaaaccgacatctacatattcctgcagatcgacactgctattataacggacatcatatacgccaagcagcgttcctttatttgaagttaccaatccgggaatacggaaagaagccgaaccgtcatcaccggcatggcggacgcccactgccattcgatgaatgatgtctttcggcgaccgttcttcacaaatggcttctttaccatcgatcttcactgattgaagttcagaacttattttcgtgaatagagaagtctccggcttcatctgcaagctgatccaaaagaaattaatccccgggaacaacttataatgactcttcaaaactacttttgcagaaggctgcaaggcttccgcacattttatcgaataagacggtattgctgccaatgtattccccggacggtgactggatatatagtcaacaggtgcaaacctcttctttcctttatcttgtaaagcttccgtaccgccataatagagtttgactgcctgtacatccgacagattgacactctttccaaaatccaaaacgatctcatccatcatccggctttcttttgcatctaaacgaaagtagaacaatacgttatcctgccgctcaattaaaataggaatttgcgtctgatgtacaaaaacggtgtctgaagctttcacaaagatagagcaccctaacaagagaataagggtaaataaataatgatttcttttcataaatgggggtattagttaatttaacgaaggcaaagataagattttctctgcatatatttaacagtcaaagcgacaaacttgcgttttttaccaagttctcgtaggactagtcaacactctgaccaccgttcttgctcttgtgatcattgacagggtcggccgcaaggcataaaacaatatttgttcaaagaggatattgttatttatgtgaatatctttgctgtttatatcatttaaatggtttgattcgataaagttaaatgcagtccggcagtattcagctataaactccaagtcatttcctccgataattcctgcattatatgacatgatagagtctttttctaattctttttttaggaaggatggcattaataaatctttttgtagaatatgattcatcatacttttataataactgcttcctatttctttgttctgagcaatcaattcactcatctctatggtgttgtctagtttattaggcaaatatacatctccgtctacatgtatgaagggttctttttggagtgaataggttaataacttgggatatgcccaatgaggttcagggcaagttagattgtcgtattgaatgatgatatctgtatacggtagtttcaattgttcggcaaagatttcatatccatgggaatcggtatataaaacgatattttgatagttgtcttttaaagaaagacaacttaatgcccatgacattaaatggtattgtggattcatccatccaaaactattgtctaacaatgaattatttccatgccaaaaggtttgtactattttcataactattgatttgttgtgtgttatttctatagtgataaaattagtaataatgtggaggaaaaggtccttcagatagggctaattcgcatggttggcgcaaatgtttacttttttggcagtgaaatatgttttttgtgcatcaatcttgataaatataagaactgcaaggatcagcacaacctctgttcattcagaattgtgtaatccttgcagttttatttatgtcgggtagaaagaaacagtttgtttagggcagcggatctgcggcagcaggtttcttcggattgtagatagccatacccaccttggaatctgcgcaaccataatacagataccatttatccttataataaaccatcccttcgatgaacaccgttccgtctacatactgcccgctcttttcgaaactatccatcgggcggaagaacggttcgtcgagacgggtgatgaaacgggtcgggtcattggcgtcgaagagggcttgtccggcagcgtaaacattggcggtatagcgtttgtcgcctctgcttgcactgtttttaccattatacagaagtacgattccctttggagtataaatagctggaggaccgcattccgtcagctggctgtcgaagtgtccgtcacggggtgaaaacagttttctcagcgagccgtccgtatttacgtatggagtccagttgactaaatcttcggaagtggcggcaaacacatgttcctctccccaatacatgaagtattttccgtcgattttcttgatcacctgtttcccattgacaacttcggtcagaatggagccggacttgcatcctaaattgaagaacttgccgtcatacgctttggcaaaagcgggaccgtgctttgtccagtctttcagattgcgggaagtggctattgccagacgcggaatgtggcggttccattgcgtataggtcatcacatacagtccttctgctgtgacggcgatacgcgggtcttcgcatccgcccggccattccagtttcttttgagtatcgttatccggataaaataccggggtcttttcccgcttgaagtgaatgccgtcgctcgaagtggcgtatccgagacgtgaggtacggtgaccgataccgacaccggatttatcttctgcccgatacagcacgacaatcttgccgtcatgcagggtagcagccggattgaaagtgtcattggattcccatgcaacgtaatcctgtgtcatcggacaatagaatttcgtgttctctataggagatatcaccggattagctccctgtggtcgttcgaagcctccgaacgcccagtcgggtaatacgttctttttgtcgttggaaggttgtcccaaggcggtacaagtcatcatggttgtagtaaccagaaataaaaaggttgatttcatattatataattattattgggggagtaatatatactctctacatataaattaaaaaataaaaatatgctgtcatctgtcacataaatgggggcaaatagatgattatgtgattgttatgaggtgacggcaaggtgtgatagcagagtgacagtagttttgctgtcactgtggcatcgcggagacgcttacggcgaagaaggtcggtttctgcgccttgatactaaagtttcatcggcgagaaaccaaagtttcatcggtgagaaactgtggtttcatcagtgagaaactttagtttcagcagcttgaaactctagttccagtgacttgaaactttagttccaaaggcatggaaactcttgtttcatacagtgaaacgattggttccaaagcatggaactatcggtttcaccgtatgaagcagttatcttataagtaaagatggagtagagactactgaatgctgttcaataagtccactttgccttcattgaccagtttgaggatcagctctccgaacaacgtattctgccatgcaaaccatgcacgggtaaagtttttcgggtcgtttttgttgaatgattcgtgcatgaagccggtacctgcatccgtatccatcagcattttgatgcaagttttgatttctgcgtcattctggctggtgaaggctttcatcatgatactcatgggccatatcatgtcatatccgatatgcggacctccgataccttccccggcactgcctttgaagaagtaaggattgtcttcgctccatacaaacttgcgggtattctgataaatcggatcagtcactttgacgtcacccagataaggcaaagcgatgagactcggcacgttggcgtcgtccatcagtagctgattgccgaagccatctacctcgaaagcataaatcttaccgtatttcggatggttgcagacagcatatttctttaatgctttttctacttcatccgccagtgcggtacattctttggccagcgccggtttcctgttcacggtgttcagaatttcggcagctttgcgcaaggaagtaacggcaaagaagttggaaggaacgaggaactggaaagtcgtagcgtcatccgaagggcggaaagcggaagcaatcagtccgacaggtttcaccggattgccccaaccgtcattggtcatggtgtcgagtgcgcgttcggtcttacgctggaatctgtacggacctttcgcgtcgtccttacgctgctgttccttgaaagtcttcagcacatttgcaatggcctgcagccattcgtcggagaatacgctggcatcgcccgttgttttccagtaatggtatgccaggcggatcgggtagcagagagagtcgatttcccatttgcgttcgtgaagttccggtttcatgtccgtcaggtcgctcatccattcgcctccttcggagttcatgttgaaggcgttggcgtacgggtcgatattgatacatttaaactggcggttgatgactcctgccagcatctttttcagttcggggtctttattggcaagctgcacatagggccatacctgcgcaccggagtcgcggagccacatggcgtggatgtctccggtgtatacaaaagtgtcctcttttccgtcgaagtgaacggtagtgtccagtgtgttcggaaaacagttctcgaacatccatgccagtttcgcattggtcagtagttgcttgatgtggtcaatctgtcgttccacttcctgcgatacgaataagcgcttggaggcttcgggacggttggtctggtaattattgacccgggtattgtcttgctgggtcacaaattcgcggttttccattgcttgcacgccggcagcgcccgaaagtgctgcgcagaggcaaagtgttttggttatattcatggtaattgttttctttaattcatgtaagggttaataatcaatgttttatttctcgatttcagcgaacagctcgatcaggcaggcattatcgagcagccatttataaggttcctcgttatgtcctgaccagtctctgcccagtaatccgttggcatcccggtagtttctccatgcgtggagcgcgttctctgccatcgcacggacataagtcgggttgtggtcaatcttctccagcgccttgaagcctctgaacagaatcacgttaaaccacgacatatccttgtgtaccttgactgacgggtctttcttatctgctttcgaacggaaaaaggcatcggttcccgcggctgtcttctgggcatcgcgcaagtaatccttgtctcctgtctcttcgtacagtaatacacctgcctgaatcatttgtccactgttgtaggcgtacttgtctttcgagactttccctttcaggttgatattgtcccagtaaaggaagtcgtcgggatcacacaagtgttttctggtccatgcgtaagtttccttggccttgttcagatactttttgtccttcgtcagacggtatagcttgacgccgagtactgttgacggggcattggagcaggtatgcttcgcttctttctgctgttcgcaccagaagattcctccgcccagttcgtcactccagccgctgtagatgtattcgtacagggcaatggcctttttcagatagtcggccttctttgtgaggcggtagtagtcgcaataatccagtgcgatccagatgttgtcatcgtagtagcgtccatgctgaccgtatttgacagggtacgactgatagcatgccggaaggcgttctccgtcccagtactgttccagtcccggcaggatgcgcttttccagtatcgtcttgtacttcttgtctccggtagcctggtacatggctacgcaaccggacatcatccctgagtagggccacagaaaggaggccttcaaggttccgttctgctgtgctccgcctgccagataagtgattttctggtcgggattcacgggatatgtttcggtaagcagcccgtcttccgtctgatataaattcagaacattgtcgaggatagagtcggcaatggacacgaaaggatgatttttcaccgtttttccggaagcggaagcgaggcaaaacaacatacaggctacaaaacatatatttctcatatgggtatcagattattaaatgaagtattcggggttatttttgctgacgttggtcaaacaccagttccacttttacagggaaatggtcggatggtgtacgtgcttcataagccttaatggtgatctcttccggacaatctctcacgtcctcctttttactgttttcccgtacactccgataggtatctgtcagcacaccgtatctcttgacgtggaaagaaggtgaaacgaagatatggtcgatgcggctttcggtaaaactgttcggatcgaagttgttgaaagttccgttgagcgcatatcggtagtcgcacttctcgtaagaatcacagaggacgcctttgctgacaaatgcgtcgtaggactggtgggtctggtcgacgttgaagtctcccgtcaggatagccggcagattcttgcctcttcccagctctttcatcttttcctgtacgaggaaagcgctctccacacgggctttcttgccgatgtggtccatgtggagattgaagaacagaaactcgaaaccggtatctttgcatttgaagtgcccccagctgcaaatacgaggcaatacggcatcccagcctttgctcggcacgtccggagtttccgacagccagaaatctcctttttctacgatgtcgaatttgtcggtgcggtagaagatagcggagtgttcgcctttgtctttaccgtcgtcgcggcctacgccgatatagtcataaccgggaagggcttctttcatgtctttcagttggtgaaggaagcattcctgtgtgccgaaaatatcgaaatcgtgatattgcaccatctgggcaatcaccggataacgctgtccccatccgtctccacgggcggagtcggaaccgttggcatttctcaggttgtaggaggcaacggtgagcgaagtaggctgatagctctgacagttgcagaagactatcgctgcaagaacgataaataaaaggtttcttagtttcatgttttctttagtttgtttggattagatcattcattaaagcattcaaaagtacgacattttattcaaatgaaagggaatagggaatatctttttcagtcgttccccgctgtttgttcggcgtaggactcatctgatactggatattcgctcctttcagtaattggtcgtgcgtcagataattgcgggtgaatgccttgccatttaccttcatatccttcacataacggttgtcggtgttattgttgcttgcttttattgtgacggtttttccattttccagatgcagcttggctgacttgaaaaggggagttcccagaatgtactgatctgttcccggacaaacggggtagaatcctaaagccgagaagacataccaggcagaagtctgaccgttgtcttcgtcaccgcaatatccgtcggggcctgccgtgtagagcttgtccatgatttcacgaacccaatgctgggccttccacggttctcccgaatagttgtaaagataaaccatgtgctggataggctggttgccgtgagcgtactgtcccatgttcattacctgcatttcacgcatttcgtggatcatgccacggctttccataccctgtttgcccggaatgacaaagacggaatccatcatgttgttgaattctttcttgcctcccatcaggtcgatcagtccttgcggatcatggaatacgcagaaactccagtgccagctgttaccttcgcagaactcgccgctccagtctactgcatcaaatttggggttgaacacacctttgtcgtctttgcctaccatcagtttgcgtttcgggtggtagacgttcttgtagttgagtgcacgttgtttgaagatgtcgatttcgcttgccggtttgcccagtttcttgcctagcgtgtagatggtccagtcgttgtacgcatattccagcgtacgggcaacattctgtcctataccgatattgttggggacataacccagtttgttgtaggcgtcgtatgcaaggcggcccgaagctgtgccgcggagatgggcgtttgcgtcatgtttcaatgcttcccaaagtgtttcgatgtcatatccgcgcagtcctttgatataggcgtcggctactacggaagcggagttgttgccgaccatacagtcacggtgtccgggacttgcccattccggaaggaatccgctttcaaggtacgcattgaccagtccttcctgcatcttctgattcatggacggatacatcaggttcaagaatgggaacagacagcggaacgtatcccagaagccggtatccgtaaacatatagcccggtagcacttttccgttgtaagggctgtagtgtacgacctgtcctttggcgtctatttcataaaagctgcgtgggaacagcatcgaacgatagaggcaggaatagaaagtgcgcagattgtcgatattatcgtcttccacatctactttgctcatttcacggttccagatgtcttttcctttagtgaccagctggtcgaaactatccttgcccaattctttgagattcagttccgcctgctcataactgataaaagaagaagctacacgtgcgtgaacgatctcccctttctgggtagcgaatccgatgatcgctccggtatggttgccctgaacttctgtttcgttcgggagaatgttgttctctttcacgccggaagtaaaggtaaacggcttgtcgaactggatgacaaaataattcttgaagttctccggcactccgccgctgttcttggtagaataaccgatgatcttgttttcttccggaatcacctttacataagagcctttgtcgaatgcgtcgataacgacataagcgttcttggtttccggatacgtgaaacggaacatagcggcacgctccgtcggaacgagttccgtagtaacgtcgtggtctgcgagatataccttataataataaggtttggcaacctccgccttgtgcgagaaccagctggcacgttggtcctggtcgaataccagtccgcctgtgatcggcatgatggaaaactgaccgtagtcgttcatccacgggctgggttgatgtgtttgtttgaagccccggattttgtcggcattgtaggtatatgcccaaccgtcgcccattttaccggtttgcggtgtccagaagttcattccccacggcagtgccgtagccggataggtatttccggtcgataactcaaacttggactgcgttcctaccagcgtgctgacatagtctaccggattcttgacggcagaaatttgcatgctgtacaacaccgcacctccaataaataacaggtgtttaaatgaaaaatgtgttttcatgaacaaatgaatttatgaataaaattagtttctgtgacgaaaatagagagaaaaggaatgccgctaccggaagtcgaaacactaaatcgccctgtggcgctataattaaccaaactggcacgcattcttacatatattctgcgccaaaaaagtgctggaaagtttttttgtttacctttgtcatattgcaaatctaaggattctatgccatgaaaaaacattgtattttacttttcttctgctgccttaatctgctgatgaatacagccggtgcctataatctgaagcaggttgctgacaaagaatatatgtccaacagctctattacttctctgtgccaggacgacaaaggactgatgtggatcggcacttgtgacggactcaatatctatgacggtcaggagatcgaagagtttaagacccgtgacaaggaggattacttatccggcaatcaaattgataatattatctataccggcaacgatacttattggttccagacctattatagcctgattcgtctggaccgtaaaacgaactccattacacgctttaatgagtttcagaaactcttcttgatgaataaggataatcatagcaccttgtttatcattaaagacaccaactgcatctattattttcataagaaggaaggcatctttaagaaaatcaatgtgactggtatcccgatatcggatgtcattactttcttctttgataaaaataaccgtatgtgggtgatgatgaaagggtataaccggtgttatgacctgcaacaggaccctctgacggagaatatcactttagtatcgcagaaaagcggtttggatcatcacacgccattgatttgtagcttttacgatgacgccgccgtttactatgtggataaagaatacaatctctatgcctttcatattgagagtaaaaagaatgaatttatagctaacctgggagcgaacatacaggcgcatgacaagatttcctccattgttaaatatcatgatagcttttttgtcggcttaatgatggacggtgttctgacgttggaaaaacaaaagggcagcggtgaatatcagattcagaccttacctataaatagcggaacattcagcctgataaaagaccgctttcaggatgttgtctggattggtacggatgggcagggcgtttatctttactcaaatcctctttattctataaaatcggtggtactgaataactataccgaaaagatagaacggcccgtgcgtgctttgctgcttgacaaggagcgtactttttggatcggtaccaaagggaatggaatacttaaaatttttgattatgaggtacaaaagaatatctcggactgccgctcggagatactgacaacatcgaacagtggtttaggcagtaatgcggtctactgtatcagagaaagtaaccgtaacttgctatggatcggtgatgaagaaggactgaacttttattcgtatcgtgaacgccgtatcaagaaacttcctctctggattgataatgaggaattcaaatacatacatgatatttatgaaacggaggactcggaattgtggctggccagtgtggggatgggagtagtcagagcgcgtatcggaggtacaccggatcatccggttcttgaaaagttacaacgatatgtggtcaatggcggagaattcggctctaattacttctttacgatctgcaagggggacagtctgaacctgttgttcggcaatatgggatacggggtataccgcttcaatgaaacgatcaacggattggaaccgctgaccactcataagtatgagaatatgaacttgaacaaggtagtacctattataaaagatgatgcggacaattatttgatcggtactacttatggagtcatcaagtatgcctcagaaaactcttatcaactgtttaatgcgaaagacggttttctgaacagtactattcatgccattctgaggcattcgtccgataacttctggctgagtacgaatcagggattgattaattttgataccaaaagaaatgtattccgctcttacggctttggcgacgggcttaaagtcgtcgaatttagtgacggagcttcctacagagacccgcaaacgggtatactgttttttggaggaatcaacggctttgtagctattcaggcagacggacgtcccgaacagctttatatgcctcccatctactttgacaaactctctatctttggagaacaatacaatcttggagagtttatcacccgtaaaaaagagaatgaagtactgaatttgaaatacgaccagaacttctttgccgtttcattcacctctgtcgattatctgaacggaaataactgcacctattcttataaactgaaaggattgagtgaccagtggattaataatggtaaagaaagttctgtctctttcacgaacatggctcccggtgagtatacgttattggtgaagtactacaatagtgtattcgataaagaaagtgaagtctattctttgttgatacggatcggtgacccgtggtacgcctcttggtgggcatatctcatttattctttatgtctgcttatgatagccgccatgctggtacgttcgtttattctccgcaccaaacggaaaaagcaggaactgctgaatgaaatagagaaacgccatcaaaagaatgtatttgagtcgaaacttcgtttcttcactaatatagctcacgagttctgtaccccgttgactcttatctacggtccttgcggacgtatcctttcatcaaaaggactcagtaaattcgtagtcgattatgttcagatgattcagacgaacgcggaacgtttgaataacctgattcatgaactgatcgaattccgtcgtatcgaaaccggaaaccgggaagtgaggatcgaagccctgaatgtatcttccttaatgaaaaatacggccaagacctttgtcgatatggctaaatcccggaatatcacgttcctgagcaagatacccgagcaagtttcctggaactcagacaaaggttttctgaatactattattatcaatctgatatccaatgccttcaagtatactccggatgggaaaagtatcaaaatagaagtggataccaacgatgaaaacctgctggttctccgggtggccaatgaaggaagtacgattaaagaagaagactttcaatatgttttcaaccgttatgctatcctggatagctttgaaaaccaggatgaaaagaacttctcccgtaatgggctgggacttgccatttcctacaatatggcgaaattgctgaatggtacgctgaaggtggaaaatacgcctgacggctgggtattgtttactttgtcattgcctccgctggaagtgactaccggcgtatcgtcttctaaacgaatcacttcggaatacattccaaaaatagagtcgcaactggtgctgaaacttcctcactatgaatttgacaagatgcggcctacattgctggtgattgatgatgaactggaaatgttgtggttcatcggggaaatcttctctaacgattttaatgtggtcaccctgcaggagccggaacgggtggagcaggtattgaatgaagtttatccgaatgtgatcatttgcgatatcatgatgccgggagttggcggtatcgaattgacgaaacggattaagtcggtgaaggaaacgtcacatatacctattattatggtttccggccggcatgaaatggaacagcagatggctgcactttctgcaggagccgagatgtatatcaccaaaccgtttaatgccgaatatctccgtatctctgtttgtcagatgttggaacgtaaggaagtactgaaggattatttcagttcagcaatcagctcttttgaaaagacagatggtaaactgacacataaggaatcgaaaaagttccagcaatctgttctgaagattatcaatgaccacattcaggagaaggaactgactccccgtttcatagccgatcatttggctatcagcgttcgcagcctttaccggaaaatggaggagatgggggaagaaagtcctacgattatgattaaggagtgtcgtttgtatgtagcgaaagatttgctgctgaaaacgaaaaagacgattgatgaaattgtattcgaagccggattctctaataaggtcactttctttaaagtatttcgtgaaaagtacggatgcacgccaaaagaattccggaccaaacacttggaagaagtacaataattattggagtggtatggcaacaattagaattttttcgaattttcattcgaaaaaaataatactgagtaattggaggatttttctctttatccctaccagtagcagttttaatttatgaaatagaaagatatgatagtgtcgcatttagtttatatatgagtaaatgtctatgccaaagaagtaaaaaaggaagttcgttctccagttattgttttcttgatttttatcttgattttaatagcggggaatttaacctttaaggagaactggaatactattaaatcatgccaaaatagtaaatatccctgccgtataatataaaacacaaagaaggaaaactaaaaatcttggcaaacacattaattttgctggtgcattaaaaaggtcagaataatataatatgtttaactaaatatctcatgaaactatgaatcaacaacacgatcctccacctgttttttaagtatgtaataccaataataaaccctttttcatcttctttctttttaagttataaaataaaaacatgttttgttttcgggggcaaaattaagctacttcttcatcttaaacaaatatttagttagttttttataataatcaccaaacaaatcattattaatggctgattatcagggctgaacaaatacaattaaaaataacatcatccaacaaaaaaggctgtaatcattctctcacgagacgattacagcccaattatcagaaagttaactttctaaccagtttatctttctatccttcaattgctgcctgcgccgctgctaatcttgcgataggtacccggaacggagagcaactaacgtaattcaaacctactctatggcagaacttcactgaagacggttcaccaccatgttcgccacagataccgcatttcaaatccggacggatagcacggcccttttctgtagccatacgtaccaactgacctacaccattctgatcgagcacctggaacgggtctactttcagaatcttcttttccagataaaccggaaggaaggaagcgatatcgtcacgagaatatccgaaggtcatctgagtcaagtcattcgttccgaatgagaagaattcagcagatgaagcaatacggtcagcagtcagagctgcacgaggaatttcaatcatagtacctactttgaaatcaatgctgtcgcccacttcttcaaacaacttggcagcctcttcacgaatcaccttctcttgttccttgaattcatataaaataccggtcaacggaaccatgatttcaggatgtgtctctactccttctttcttcagttcaagagcagcacccaagatagcacgtgtctgcatctgagttatttcaggatatgtatttcccaaacggcaaccgcggtgacccaacatcggattgtgttcacacagcgattctacacgttgctggatatattgcaggcttacacccatcgtatcagccatttcctgctgtcccttcgtatcatgaggaacaaactcatgcaaaggaggatcgagcagacgaacagtcaccggacaaccgaccattgctttaaagatacccttaaagtcggcttgctgatacggaagaatcttagcgagtgctttacgacgtccttctgcattttctgccagaatcatttcacgcatcgccttgatcttttcaccttcgaagaacatatgttccgtacggcaaagaccgatacctactgcaccaaagttgcgtgctacttctgcatcgtgaggagtatccgcattggtacgtacttgcagacgggtatatttatccgagagtttcatcaaatcggcaaagtctccggaaagttcggcagcctgagtttctaccttaccattatatacttcgcctgtactaccgttcaaagaaatataatcgccttctttcaaaacaatgccgtcaatttctactgtacgagtcttatagtcgatattcaatgctcctgcaccggatacacaacatttacccataccacgagctaccacagcagcatgagaagtcataccaccacgagctgtcaggataccttcggcaactgccataccggccaagtcttccggagaagtctcgatacgtaccattaccactttctttccggcagcatgccattcggcggcatcatcagcgaagaatacaatctgaccggttgcagcacccggagaagccggaagaccgcgagtcagcactttcgcctgtttcaaagcagatttatcgaataccgggtgaagaagttcatccagtttgttaggttctacacgcatcaaagcagtcttttcatcaatcatgccctgacggagcaagtccattgcgattttcaccatagccgcaccggtacgtttaccgttacgagtctgcaggaaccataacttaccttcctgcacggtgaattccatgtcttgcatatctttatagtggttctccaatttagtctgcaatgcatccagttccttatagatttccggcatagcttcttccattgaagggaattttgcagcacgaatgtcttcagtcacacctgccagtacagcccagcgctgagaaccaaccttcgtaatctgttgtggagtacggataccggctaccacatcttcaccttgtgcgttgatcaggtattcaccgttgaaaaggtcttcacctgtaccggcatcacgagagaagcaaactcctgttgcagaagtgtcacccatattaccgaataccatagcctgtacgtttacagctgttccccattcatcaggtataccttccatcttacgataaaggatagcacgttcgttcatccatgaatcaaatacggcacagatagctccccaaagttgttcgtaagcacaagtcgggaaatcttttccggtctgttctttcacagcggccttgaacttcttcacaagctcttgcaggtctgctacttccagttcgttatcaagctttactccttttgattcttttacttcttcaatgattgcttcgaacggatcgatatcttccttgttcgtcggcttcatgcccagaacaacgtcaccgtacatctgtacaaaacgacgataagagtcccatgcaaaacgggcattaccagtcttgcggatgataccttccaccacctcgtcattcagacccagattcagaatagtatccatcatacccggcatagacgcacgggcacctgaacgtacagaaaccaacaatggattttcgatatcaccgaatttagatttcatcaattcttctacacgggcaatggcctttactacttcatctttcagcaactcaaccactttatcacgtcccaacgtattatactccgtgcaaacttctgtagttattgtaaatccgggaggaacgggaattccaattaaattcatctcggcaagattggcacctttaccacctaacaaattcttcatgtcggcctttccttctgcctgaccatttccaaaggtataaactctttttttatccataatattgtgtttaaagttacattatgatttttttctgttcgcaaatctaagtatatttcgcaaaccagaaaactttttgagaaaaaactttctattaaaatgcaatttcgacattacaatctggaatattttcatagacacgaaagttttccaaaaaaaatacctacttttgcatcataattattagattggtgtaaaagtggcaagaaagagaaaagaacttcccctgctggagaaggtaacaataacggatgtggctgccgaaggaaaagccatcgcaaaagtaaacgacctggtgatttttgttccttatgtagtgccaggtgatgttgtagacctgcagatcaagcgcaaaaagaacaaatacgccgaagccgaagctgtgaaattccacgagctgtcgcccgtacgtgccgttcctttctgccaacactacggcgtatgcggcggttgtaaatggcaggtactcccctattcggaacaaatcaggtataagcagaaacaagtagaagacaatctgagacgcatcggaaagatcgaacttccggaaatttcaccgattctgggttctgccaaaacagagttctaccggaataaactggagttcactttttcgaacaaacgctggctcacgaacgatgaagttcggcaggatgtgaagtatgatcagatgaatgctgtaggttttcatattcccggagctttcgacaaagtgctggctattgaaaaatgctggttacaggacgacatctccaatcgtattcgtaatgctgtacgcgattatgcttacgagcatgattactccttcatcaatctgcgtactcaggaaggtatgttacggaatctgattatccgcacttcatcaacaggagagctgatggtcattgtcatctgcaagattacagaagaccatgaaatggaactattcaagcaactgctgcagttcattgccgattcattccccgaaatcacttctctcctatacattattaataataagtgcaacgatacgatcaatgatctggatgtacatgtattcaagggaaaagaccatatgtttgaagaaatggaaggactgcgtttcaaagtcggtccgaaatcattctatcagaccaattccgaacaggcatacaatttatataagatagcccgcgaatttgccgggctgaccggaaaggaactggtatacgacctatataccggaacgggaaccattgccaattttgtatcccgccaggctcgtcaggtgattggtatcgagtatgtaccggaagctatcgaagacgcaaaggtaaatgccgagattaatgagattaagaatgccttgttctatgccggagatatgaaagatatgctgactcaggaatttatcaatcagcatggacgtccggatgtgattatcaccgaccctccacgtgcaggtatgcatcaggatgtggttgatgttattctgtttgccgaaccgaagcggattgtgtatgtaagctgcaacccggctacgcaggcacgcgacttacaactgcttgacggcaaatataaagtgaaagctgtgcaacctgtagatatgttcccgcatacgcatcatgtggaaaatgtagtgttgctggagcttcgataatacgttagttgaattgttcgcaaaagaaaaaagaaatggaaaaaagaccgagaagaactcctgcagaaaaagcacgtgcccaatatacgaactatgcagtcaaagagcccatggaactaatggagtttctggctgccaaaatgccggacgcaagccgcacgaaactgaagtcattactgagcaaacgggtggtattggtagataacgtaatcaccactcagttcaacttcccgctgcaacccggaatgaaagtacaaatcagcaaggaaaaaggaaagaaggaatttcataacagactgctgaaaattgtatatgaggacgcttatatcattgtagtggaaaaaatgcaaggactcttatctgtcaataccgagcgacaaaaagagcgcaccgcttatacgattctgaatgaatatgtacagcgctcgggcagacagcaccgtgtgtttatcgtacatcgtctggacagggatacatcaggattaatgatgttcgcaaaagacgaaaaaacacaacggacattacgtgacaactggcatgaaatagtgactgaccgccgttatgtagctgttgttgagggaacaatggagaaggattatgacactgtggtttcctggctgacggataaaactctttatgtaagttccagcgattacgatgatggtggttcaaaatccatcacacactacaagacaatcaaacgtgctaacggttattcactgttagaacttgatctggaaacaggacgtaagaatcagattcgtgtacatatgcaggatttaggacatcctattataggtgacggaagatatggaggcgaagaatcgcttaacccgatcggaagactggcactccacgccttcaaactttgtttctatcatccggtgacgggagatttaatggagtttgagacaccttatccgggagagtttaagaagttgttcctgaagaaataaaataataaaaattccccttatttgctgacaactctgtacatagattagccttcaataaggggaacttttataaaaaatcgatattttttccaattccacaattcttttttagatcttcactaattactcatttctaaagtaacggttccttgatctatattatttgaatacaaacgccctgtaagatatcggccttcaacataaacatctgctaatattaataaaggatagccattaccataatccaagaataaatctccatcttcaatccaccagcggacatctaaaacagcagctactctatcccaatcataataccattgttcatctacaccaaaaccattactcttaaaggttattccactttccaccggactattatctacccaaaatcctaaatcaccaacccatgtacgccctactatgtgatcaaatatagtttcatcatcttcgcacgaagtaaagccgaccaataaagtcagcaacatgagaacacctacgtattttttcaaattcttcataattttctagtttattgcgtttattattgcaaaattagcgtttttattttactatatgccttaagatgcaagttttttgtacctttgtcccactaatagtaaaatttacacatgaaacttctttggcttgatttaaatagctcctatgcgcactcatcgctggcattgcctgcattacatgctcaaatagcagatgacactaccattgagtggtgtacagtatcggcaaccatcaacgaaaataccggaatggtagtcaaccaaatctatcaccatcaaccggatattattgctgctaccaactggctatttaatcacgagcaactgttgcatatcgtttcacgtgctaaagctttgctacctcattgctgcatcgtactcggcggtccggagtttttaggaaataacgaagccttcttaagaaagaacaaatttgtcaacggagtgtttcggggagaaggagaagaagtattcccaatttggttaaaagtatggaatcaccctgtaaatgagtggaatcagatatccggattatgttatctggacgaatcagaccaatatcaagacaacggtattgcccgtgtcatgaacttctctcagctcgtctcaccggagaaaagtcgtttttttaattggagcaagcctttcgtacaactggaaactacccgaggatgcttcaacacatgcgctttctgcgtcagcggaggtgagaaaccggttcgcaccatttcattggaggcaatccgcgaacgactgaatgttatccatcagcatggcatcaaaaatgtgcgtgtactcgaccgcactttcaactataataataagcgagccaaagaacttcttcacctcttccgtgaatatgccccggacatctgtttccatttggaaattcacccggcacttctctccgaagaattgaaagaagaactcgctattttacctaatggtttgctacacctcgaagcaggtattcaaagccttcgtgaacccgtattagagaaaagccgacgtatcggaaaattatctgatgcccttcaaggtctgaaatatctttgttcccttaagaacatggagacacatgctgacttaatagccggtcttcctctctatcacctatccgaaatatttgaagacgttcgtacacttgccgaatatggtgcaggggaaatacaactggaatcattaaaattacttcccggcacggaaatgcgaagaagggcggaagagttaggcatccaatactctcctctccctccctacgaagttttgcagactaaagaaatttccgtagaagaattgcaaaccgcccactatctgtcccgtcttttagacggattctataatacacctacatggcgaagtctgactcgtaccctcattttggataatccgcatttcctgcatgagttacttgaccatctaatacagacagatgtcatcgacactcctttgagtctagaaaaaaggggacttatcctctataatttctgcaagaatcattatcccgattacgtgacacaagtcagtattgcatggatagaagccggtatgtcgttaaaaaaaatccccgctgaaaaagtaaagacaaaacgccaagttcctcccgataattgggaaattatatatggttcatatcgtgagaacctccggttatgttttcttcctattgacgaagcaggacatggctattggttcggatttgaatcggagattcagaagatagaaccggtatttaaagcaaaaagattatcttaaatacaaaacattaaagaatgataataagaactatgagtcctgcaatgctcagaaaaaaagtggttgtaattataacatctatatttttccacctcattttttctctcaatatcattcaagatttatgaaagatgaaccaatcaagaaactagaacttatcactcaatacataaaaaaacagctatataggttttgtttccataggtgcgactggacacgataaatgtgcttaatacacctatacaaaaaaagaaaagtattctcatattatgtaaaatagctattatttattcattacataaagcagcattttcactttttcaccgtccatagaataaactatactagcacactatatggacgcttataaatatcagttaggtactctttgtctattattactccccttatccgtagcaggacaagagtggagcaaacaagattcattgaggctacagcaaacattaaattctgagcaagaaatcagaatcaataaggtattcgtaaagaagacagaacaaaacatgttatatcatacaaaaccctttgttgactttgatccaacattaccgattcttaaatcaacaatcatatctccgaaattaccttttcatactcataacatctttcgacagaccaattctactttcttacccacttattcacggctcaaaataaacaaaaatatcactctgcatagtaaaagtaactttagtgaaagttcaaaccactttcatatccaaactcaaatggattataagctctctaaaaaatggtttcttagcatatatggtaaacaaaatctggacacccgaagatatcgtggactttcctctgaagcaataccaaccacactaggcagcgacattgttttaaaagtaggtaaaggctggaaattgaaaaccggcgtacaatatcaatacaacaccatacaaaaaagatgggaatgggtgcctcagatctgtatttcttatgaatggtaaaaaaggaatcacatgataaacgatttcattttccatttattctcgtacctttgtagtacgattaaaaaacatcctataataatgaagaactttatcaagggattccggtttactccctccaattacccggctgaagtagaagcgaaaatacagaaatacagaaaacaaggttacaaactcccaccgcgcaaagtactgcgtactcccgaacaactggaaggaatccgtgagagtgccaaaatcaatactgccctgttggattatatttcggagaatatccgtgaaggaatgtcgactgaagaaatcgatgtcatggtatatgacttcaccacaaagcacggtgccatccctgctcctctcaactacgaaggatttcctaaaagcgtctgcaccagtatcaatgatgtggtatgccacggtattcccagcaaaacagaaatactgcaaagcggagatatcatcaatgtagatgtttctaccatttacaaaggatatttctccgacgcatcccgtatgtttatgatcggtgacgtaagtcccgaaatgcgcaaactggttcaagtgactaaagagtgtatggaaataggtatagccgccgcacagccttggaaacaattaggagatgtaggcgccgctattcaggaacacgcagaaaagaacggattcaacgtggtacgcgatctttgcgggcatggtgtaggaatgcagtttcatgaagcaccggatgtggaacatttcggacgccggggaacaggaatgatgatcgttccgggcatgaccttcaccattgaaccgatgataaatatgggtacttatgaagtatttgttgacgaagctgacggatggacggtatgcacggatgacggactgccttctgcccaatgggagaatatgattctgattactgaaaccggaaacgaaattctgacttattgatggaactgattctacttattgttattgccgcattagcagtaatctcgattgtactatcactggcaaaaggaaataatcatgcgcaagcggaacaattacaggcagccttgcgccagcaaatgcaagagaaccgcgaagaactaaaccgcagtatccgggaacttcgcatggaaatgacccaaacgctgaatcagaatatgcaacaattgcaagacgtactgcataagaacatgatgacaaacggggaactgcaacgccaaaagttcgacacaatggcacgccagcaagaggtcttgataaaatcgactgaaaagcggctggatgatatgcgactgatggtggaagaaaaattgcagaagacattgaatgaacgcattggacagtcctttgaaatcgtccgctcacaactggaaaatgtacagaagggactgggagaaatgaaatctctcgcacaagacgtcggtggactgaaaaaagtattgagtaacgtaaaaatgcgcggtacattcggtgaagttcagttaggagcattgctggaacagatgatgagtccggaacaatatgacgccaatgtgaaaaccaagaaaagcggaactgaatttgtggaatttgccattaagttaccgggtaaggatgatgcgaacagcactgtatacctgcctatcgatgcaaaattcccgaaagatgtatatgagcaatactacgacgctttcgaggcaggagatactgcattgatggaatcatccggcaagcagctggaaacaaccatcaagaaaatggcgaaagatattcacgataaatatgtagacccgcctttcaccacagactttgccatcatgttcctgccttttgaaagcatctatgcagaggtgatccgaagaacaagcttggtagagacgctacaaaaagaatataaaattgtagtgacgggaccaactacccttggtgctatattgaacagtcttcagatggggttccgcacgctggctattcaaaagcgtaccggagaagtgtggacagttttgggagcagttaaaactgaattcagcaaattcggaggcctactcgaaaaggtacagaagaacctgcaaagtgccggtgaccaactggaagaagtgatgggaaaaagaacccgcgctattgaacggaaactacgccaagtagaacaattgccccatgaggaaagtcagagaattctgccgatagcggatgacggggatgatgaataaaacaaaaattatagaccttttaagatggtgtcgctatccggttgggatagtgtcactatgctgattggatagtgtcactatgctggctatatagtgacactatttataaactaattagttatcagttgaataattaatcttcaatgcactacattccctcagcacctgcttggtatccgtcacgtatcccatcttacaccctttctctatcttgaggccaataaccaaactttccggatcagcagcttgctttgcacgtgcagcagtgactttctgtttcaattccgttaaagtataatctttcattacttccttcccttccgaagtgtgaattgttaccacaatcccactgattttctcctccattgacagctctttcaatccataatttctcgtagcaccttccgacagtagaacgggaaacaatcggtccaacgcttcttcacttttatctgtcaatgtaatagacaaatcagcacgaatttgctcaaatgctccttttacttctttgagtatagtagtgagtgcagcaatttcacttccgcgatcaacctgaaaagaaataacttggtattctttcctcttactttcttcccaggacttcgtcaaattcttcacaatagtagacttcaactcatccactgaacatacatcattatcgaacatcaccctattttgtttattaacaaaaagggagtgaacctgtcttgctttaatcttagagggtggatacgctccattaaccagcttgctgtatctctctcccccttctttgaaaaaaaacatcaaagatgaataatcatccgcttctttctgctgaagttcagactgaatctgtcgcggaacttctttcacttccggctgtgcaaacacataaagcgctccagccatcacaggcacggcaagcaacagctttaatcgtgcccaacgattggttctttcttttaacatcatagtgatacgttttttaagtttagagtgattaaagccattagccatagagtagagccttgtaccaacagcttttttcaccagtaataattgatatttagttgcatcgatgcctgtattaattacaccattatcggcttcaaattcatgtacttcctgcaactcccgttttagtagccaaacgacaggattaaaccaataaacaagcaggaatatctgcataaacaataagtccaaagtatgatgatttcgtaaatgcatcatttcgtggaggagtatttcttcggactgttgagagtagtcagctgctgaaataacaatatatttaccccagctaaatgaagcagttggctgctgaggaatcactaatacatagtttccaaactgttttttctctgacgtacgaatcaactgaatcaaacgacaagtggacaaagacaaccagatcagtgtcaccaaagcccccactccatatataaaagctaaagtcacaggaatccaattcaaagagtttatttccggattcttttcagatataagaataggatcttccatctgttccggatttagaatgacagattccgtactttgcaatatctcgtgaatggcatacaacggagtatgcaaaaaagtctcctcggtagttgtcagctctataagtggaagcaaagtacatcctaacaacccaaccaacaaagtgatgcggttgaaatggaaaaaagtactccggctcatcagcagcttaaagaaaatataaaagaccactaagcaacatccggatttcagcagatagaataaaaaagctcccattgtgttttcagattaaaagttgtttgtccatagaataaaaatcgtatctgtccgatagaccagagagagattacttcttctttttactttgctctatatactctataagcgattttagttcatcaacagacatcccttcttcttcaataaaagaagacactacattgatataggaattattataatactgggaaaccacttctttgagtgccgaactcttatactccttttccgaaacaagagcataatattgataagtatttccgtaggctttataccccacaaaacctttctcctccagccctcgaacaagggtagaaactgtgttataatgcggttttggttcatcatagaatgatagaagttcacgaacaaacataggtccatgttcccaaaatatacgcataatttcttcctctttgacggtcaatcgtttcatctgtttcatagtctacatatttattgttcttccaatggcacaaatataatactatttttcaaacaaacaactaacactattagttaatctactaaataaagcagttgtttaactaatattattagtagatatcattttcaccttatattatatatattatattataaaaaaatacgtatatattatccaaaaacccaaaaatgagagaatctgaattggtactaaatggaagttattccaaaagtacccaaccaaaagcacgggcacctcctgagcagcccgcattacttacaatatatttaacatttatgtttaataaaaaataatcaaattaattattgttacttggaggagatttgccctattcctttcaaaagggttcaaacattagaattaaaactctacatatatactacgcattcccgatatcagccttcaaagaacaaataattttgagatcatgttatttgaacttattgatatacaatcatgagaccataatactgtgcatttttccttgcttcaaacccgaacaagaggaatagatcaatttcaccaagtgacgttactaaaaaaacagattaatatgaaatatttaattataacgtcattatacacttctattatcgcagttacaaccacccaaagtgaattatttccaattttattttcaacagcaggaatacttttattgtattggttcttgtctcattcttttgccatgcggaaagaaattgctttcttaaaagaagaaaatcagtacttcatggattccttccgaaacattcgcaccccaatcacattgcttcatacgcctttgaagtcaacctataacaagaattgcccagacaatatcaaaaaggagctgtcactggcgattcgcaatatagattgccttaatgatcatttaaccagattaatggacctgaagcaaatagccgctcattccctaaaaatgaatattacggaacatgaattaggaaatttccttaaaaataaaatatcttctctgaaagatcatgcagcaaacagacatattaaattagaaatccaaacagaattcaaatatgcaagcgtgtggatagatcaaagtaaaatatctcccgtaatagagaaattcataaagaatataatagatcatacagaatattcaaaaaaagttattatacacgcatctttatgcaacaaatattggataataaaagcgagttatacgggaaatgaaaacctaatgaaatgctataaatgctccggtaaacatcttattaaacaaaaaacagaacctaaatattactttgcaaaaagtgctttatgcaaaaaactgacagaaatatgcaatggagaaatattaatcaataattcatgtcatacgatcacattgcgttttcctgtaaaaccctcttatgaaaatgtatccgaacgcagtttggttcatatagagaagaatatagaagaagaaaagatcgatgccttattccataaaagttcacagaaaagaaattcatccagacctgtcgtgattatggtcgacagtaacgaagagttcagatcctatctggaaacctgtttgtcagaggaatacatagtcagaggctttgaaaacggagcggacgcattgggatatatcaaaaatgaacatccggatctggtaatatgcgatacagtgctcaacggaatgggcggtgatgaactttcttcaaggctgaagacgtctaaagaaacatctattataccggtcatcctttacggatcgcatatagatgccgaccaacgcagtaaaagggaagcgtcattagcagacacattcatgcatactccttttcatgtggaggatttaaagatagagattgctgttcttatcaggaacagccgccttcttagaaaagcattcctgcacaaagtattcggagaacattttctgcaagtacaaccaaccgaaatgatcaaggaagctactgaaggaagcaaaagcctattgatcaatgaagtaaaagagtatattcttgaacgcatagagaaagaggatttgactatcgatgcgattgcctcacatttgaaaatgagcagaacgaaattctacaataagtggaagtcagtgaccggcgaggccccgaccgtctttattgaagcggttcgaatggaaaaggcacacgagttgttagaaagcgggaaataccctgtcggaaccataccggaaatgatcggattgaaggatgtaaaaaacttccgcaacaggtataaagaatacttcggaattacacctaaagaatcgatcaagaaaaaatagtcggaatagaacggacaactaaaagcatgtccgaatgtactccagcacggtcttcacggagaaagtgactggagtacttttttatttccatgatgcagtatttcgtcatttccggtatttactctatgtacgtacaccttaattttgagaattaataacctaatttgtttaacaagtatgaaaactttaactaaaatgaaaaaagtatgttgcttaagtcgttttgttttattggtaatggcattggggatgaccagtatctttacctcttgtagtagtgatgatgatgaaaatattccggtatattctctcaaagatgtagaaggcacctattccggcaaaatgcagacaacctctatcgctcctttggaaaatgcagagaatgaagctgaagacggagtcaccgtaaatgccgaattaaaagataatcatatattaatcagcaaattcccggtagaggatctgatcaaaagcattatcgaagatccggacgcagccgaagccatcatcaaagcggtaggagatgtagaatacaaaatcccttatcaggcagctttcaatgataataaagacaacatcttacttcaaatgtcacctgaacccttggtattggaaatcgcaatggaaccacaacccataagaaaaactgaaggggaagaagaaactcctaaactcaccgtaaaagtgacaatcaaagctgacgagaaaggcagttatgcttatgaaggtcagaaactgaagtttgctattcaggcaacagaagttacagtaaatgaagaacggtttgataaatttccggcaacgaccttttcttttgatatgactaagaaataaggtgactgtttaattatttacagaataaaatgtaaaagagagtgtgtctgcgaaagaagacgcactcttttttttatagacgaaaggcatcatccgttctatgaaaagagtaggataaaaaacggtggatgacaaacgatgcccggttttaaccgtatcattcgtttatcatccaccgcttattaccgagtgtttttaacttaccgcttcacattcttttttctctttcttctgcttctgcgattttgttgtttccgacggctgtagcgttgccatctcttataaatcatccatccgctcatcaaagctacgacaacaaaaatcagaatagtaatacctacccccaggttgtcacctttgatgcgtgaccagatatccagtacctctttggttttatctccgaagtcacgaatcatagcgcagcgttccaccaccttacggtcgggatattgaatcttatcaatctgtatgctgtcggcatccggatcgaagaaataacttaaatccgcataataatccagagtcgtatccactttctcttccagaatctccggtgtagcgatagaactcacatatccacagaaatccatattacgcaacgcaatgtccggacggcacataaagttgataaagtagctggcagccaccggattcttcgcatatttaggaatcacccagccatcataccagatattacttccttctttcggaaccacgtagtcaaggtccactcctaccgcattcgcctcttcaatcgcccatatcgcatcgccactccaggtcatattcagccatgctttattcttcgtcatcatctccttaccgaagtccgcttcccaaccggcaatattcggtttcatagctttcagatacttttcggctacctccatagcacgtggcgagtaatcattcatcaggtcttccaccgtcaccgtcccttcttccagctctttggcatgggcatagataacagctgttccataagcgtcacggtaactgtctttcatcagaatctttcctgcatatttcttatcccaaagacattcccaggagaaagcgtcggaatcgggaacgtatgcccggttataaagaatacctgcggtcccccacatatagcagacagcgtaacggcttgcttcttcacccggctgactcagtttattaatctgttcgcgaataaatggtgacacattattcatgtaattaggggaatgggcgaaagtggtgtcaataggcaacaacagatgctttttcagcattctctcaatgatatattccgaaggacaaaccacatcaaaatcctcatgtcctttttctattttcgtcaacatgatctcgttgatgtcgaatgtctgatagacgatgcggatatcttcacctgtctgttctttatagtacgcctggaaatcttcgagtacaccttctcctatataatctgcccagttatagatcttaagaactctctcgcgtggctcgccggaattgtagcaaccgctcagaaaaccagccagcaccagcaaaaacaagttaacagcaactattcttttcattttatttacgtagcagtacatgttcatgattctttcttcttcgtttttccggcacggtaattaattactatcagtaaagccagtaccaccacaaaaataatggcggacaacgggcggagctcgggagtcagacctcccttgcgggcatcggcatagatataggtggaaagcgtttccagcccttgattaccgatggtaaatacagttacggcaaaatcatcgattgaaagcgtcagtgcaagcataaagccgctgatcattcccggacgaatctccggaatgattaccttccgcaaagcctgcataggtgtagctcccaaatcgagggcagcttcataaatgttcggattcatttgtttcaggcgcggcagaacgcttaatacgacgtaaggagtacaaaaagtgatgtgcgccagtaccactgtggtatatccctgcgtgattccgagagatacgaataaaaggaaaagcgatataccggttatgatatcaccgttcagaataggaatactattcacaaaaccaatcgccttgcgcgagcgtgcttttaagttgaagatgccgatggcagcgatgctgcccaacaaggtagatgccgtggcagccagcagcgcaatggtaatggtattgatcagggcattcatcagagaatgatgggcacctgtattaaatagcgatgaataaagtttggtcgaaaacccggtccagttacccaataccttcgcctcggtaaaagagtaaatcacaatgatcacaataggggaatatagcaacagcagtaatacccacaggtaagtctgagcgaatatcttctttaccatagcccacctccttcgttcgtattatccttatcatcggtactgaacagtgaagtcgcggctatcagcagcagcatgatcagcgaaagtgctgccccatagttccacatactgttattgatattctcctgaatggtagtaccaaagagtttgatattgttcatcgtcagcagttcggcaatggcgaatgtcgaaatagtcggcataaacaccatcatgataccgctcatgactcccggcatggaaagcgggagaactgctttgaaaaagacctgtacaggattagcccccaagtcctgcgccgcctcaatgtagctatggtccatcttctgcaatgtgttatagatgggatagatcatgaaggggataaagttgtaaaccataccgaagatcagtgctccctctcccagcggaacgctgaaaaagtcgaataaagcgacagtggcaagggtacgtaccagaatattcacccacatgggcaggataaacaacaccaccattgttttggaacggttcagcttgctgttgcttaatatccaggctgcgggatatcccagcaggatacagataagagtcgtaataatggcaatacctatggaatagacgaaggtattgatcgcttcgggatgttcgaagaatttctgaaaattggcgagtgtcagatgaccgttatcatcggtaaacgcatacacgacaattagaaccaacggtatgaccacaaagatcgccgagaaaataatgtaaggaagagtccagctcttacgtgatgacaaaaatactataaacttcttattcacttcctttcctgttaatcggttattttaattacacgaatcgcatccggagggatagtaatacccacacggtctccgtcatcccagacatcgttcgtatccacaaacacattctcgtcccagtcagaccatacagtcagatggtaatgatcacctttataaaggatgaacttcacttctcccgtcagcgtaccgtcttcttcgttatcctgcaagatcactttatcaaagtctacttcgaccttgacatccgtaccggattccagcccttccacagaagcacattcgaacgtacagcccaggaactctacatgagtagcatcctgcaactttccttcaaatgtattgcatacacgttctttcttcataatatgaatatcaaacggcttcaccagcagccccacttccgcaccgacttcaaaatgatgataatcctgaacaaggaactcatatccgccacaaagcacagtcatttcatagtgtacccctttgaagatcgaagtctgtaccacaccggtcagttgcgccatctccgaaaccgggaaaatataaaggtcttccggacgaatgactacgtccaccggagtattttcaccgaaaccttcgtccacgcattcaaactccgtaccacaaaagcgtaccagtttatcatgaatcatcgttccgttgagaatattactttctccgataaaatccgcaacaaatgaattgatcggctcattatagatatcaatcggcgtaccgatctgctggatttttccttcgctcatcacgacaatcgtatcactcaatgtcaaggcttcttcctgatcatgagttacgtatacaaatgtaatgcccagagatttatgcatttctttcagttccatctgcatatccttgcgcattttgaggtcgagcgcagccaacggttcgtcgagcagcaaaacttccggctcattgacaatggcacgggcaatagctacacgctgttgctggccaccggaaagagaatctacatcccgatactcgtaatccgtcataccaaccatcttcaatgcggctttcaccttcttgccgattgtctgtttcggcgtctttttcagcttcaggccgaaagcaatattgtcgtatacattcaaatgcgggaacagggcatatttctgaaataccgtgttcaccggacgtttatggggtggagtctgtgtgatttccttacccgatattcggatttcgccttccgaagctgtctgaaaaccggcaatgagacgcaacaatgtcgtttttccgcagccggaaggtccgagaatcgtaacaaactcgccctttttcacgttcagagttacatcatccaaagctgttttgtcgccaaaaaacttcgatacatggctaacctcaatgatggatttgtcttcttgcatattcatactaaaagtttgggctgcaaaggtacacatttctacgatttccacctacgtgttaatctaatataacagtgtttttcgatgccagacagaaaaaaaatctatctttgcataaatatttattcactaattttacaaaagcatgaaaaagttaacttatttagttattgcgacggcagcgttgggtatggtagcttgtaccggaaacaaagccggatacgttatcacaggtacagtagaaggcgctgctgacggcgacactgtttaccttcaggaagcaacaggcagaaatcttacaaaactagataccgcagtcatctctaaaggtactttcaccttcgaaggcacacaggattctgcagtaaaccgttatgtcacttgcgaagtgaacggagaacctctgatgattgatttcttccttgaaaacggtaaaataaacattgcactgacaaaggacaatgattctgcaaccggtacttccaacaatgacgcttaccaagctatcagaactcaaatcaatgatatcagccaaaagatgaacgctatctacgaagcgatgggagattcttctttgagtgacgagcagaaagaagccaagcaaaaagaaggtgcccggctggaagaagaatatgataaagtaatcaaagaaggtgtacagaaaaacatcaccaacccggtaggtgtattcttgttcaaacagactttctacaataactctactgaagagaatgcagctttgctggaacaaatcccggctaatttccaaaatgacgaaacaatcgtaaaagttaaggaacagactgaaaaacaaaagaagactgccgtaggtactaagttcattgacttcgaaatgcagactccggaaggaaaaactgtgaaactgtctgattacgcaggtaaaggtaaagtggtactggtagacttctgggctagctggtgtggtccttgccgtcgtgaaatgcctaacctggtagaagcttacgctcagtacaaaggcaaaaacttcgaaatcgtcggtgtatctcttgatcaggatgctgctgcatggaaagagtctattaaaaaactgaatatgacctggccgcaaatgtctgacctgaagttctggcagagtgaaggcgcacagctttatgcagtgaacagcattcctcacactgttctgattgatggcgacggtactatcattgcccgtggtcttcatggagaaggtcttcaggctaaattggcagaagtagtcaaataaatgaagctgataagagacttcacctaatgaagtaacacttgtgccataccgttgtcacacttgtgccaccatattggcacagttatgccacgccgttggcacagttgtgccaataggatggcacaacatccgacaaggtatcttattcctgttaacgcagtaggtaaatctgatccaagtacaggcacttttgccgaaaatactgatcttatccacaccgttacattgagatataaaaagatagcccctgcaatttcgatcgctcgaattgcaggggcttcttttatatagggacgtcaagcagggaagcgtcacttccctacttcgtcaagctatcagataaaccaacgcacgtagcagaagtcctgacggtgcggaagttccggattcttcgggaacatacggtaagacaccttgaagctaccggcatttgacaggctatgtttaacctggaatgtgtaaaggtcgccttctttcttgataacgctgaacggttctacagagtaaacgtgttgtttaccatccgcagttgtataagtagttaccagttcaagccctatagcatcattcaagcctttttcatcgattacgtaagtaatagtatattcttttccgctttcgatatcaccggctttcaaatcttccagcttgtcgcaagatacgatttcgatagaatcccacttggcaacgacttcttctttccatgcagcaatttcttttgcttttgcattgtcattagcagacagcatatggaaacgttttgccaacttattgtagaacttattgtagtagtcgtccaactggcgtttcatcgtatagtgaggagcgatctgagcgatagaattcttcactaccttgatccagccttctgagtagcctttcttgttacgagcatagtacaacggcaggatttctgtttcaagaatactgtagatagtagcagcatccaactgatcctgatgttcctgattctgataagtacgtttttcagtcaacgcccatcctgcaccttcacggtagccttccagccaccatccgtccaatacagagaagttgacaacaccgttcatcaaagccttttcacctgatgtaccggatgcttccaacggacgtgtcggagtgttcaaccagatatcaacgcctgaaaccagacgacgcgccaactgcatatcgtagttttcgaggaagataatcttacccaggaattccggacgacgggagatttcgataatacgtttgatcagaccctgtcctgctccatcgtgcggatgagccttacctgtaaacaggaactgtaccggataatcggggttgttcacaatcttagaaagacgttccaagtcagtaaacaacaagtgcgcacgtttgtaagtagcgaaacgacgaccgaaaccaatcagcaacgcattcgggttaatcttgtccatcaatgaaacgatgcgcgaaggatctccctgatttttcaaccatgtatcacggaatgatttgcggatataatccaccaacttattcttcatcgtcatacgagtcttccagatctcttcatcgggtacattatagatggcttcccaaatcttaggattcgactggtcgtaccagaagttctcgttgaaatatttaaagtacagttctttccattcggtagcactccatgtggggaagtgaacaccattagtcacataacctacatgtatttcttcggggaagtaacctttccagatagtagagaacatctcctgagaaacttttccgtgcagccagcttacaccgtttacttcctgagaagtgttgcaggcaaataccgacatacagaaacgttcgcccttgtcacccggattgttacgtccaagatccatcaggtcgtcccagctgatacccattctagcaggataaccacccatgtacttaccgaacaaaccttcgtcgaagtagtcgtgaccggcaggaaccggagtatgaactgtataaagagaagaagcgcgaaccagctcgatagactgatcgaatgtcagtccggtagctacatagtcgcagatacgctgcacattgatcaatgcagcatgtccttcgttacaatgataaacatcttttttgatacccaatgctttcagggtcaggataccaccgatacccaacaggatttcctgtttcagacggttttcccagtcgccaccataaagctgatgagtaataggacggtcgaactcgctgttcatttcattatctgtatccagcagatacaaagaaatacgtcctacatttacacgccatacgttagcatgtacataataatccagataaggaacatccaccaccatcggctgaccattcgcatccatcacacggtcgataggaagctggccgaagttctgcgcttcgtagttggcaatctgctgtccatccatagacaacgtctgagtaaagtaaccgtaacgatacaggaaacctaccgcacaaagatctacattgctgtcagaagcttctttcaagtagtcaccggccaatacacccagaccaccggaatatattttcaggacgctgctcaaaccatattccatgctgaaataagctacagacggacgggtttcatccggcttcacatccatgtaatctctgaattttgtataaacatcattcattctcctcagaatcaccttgtcttttgccaacgcttccagcttctcatagctcatacgttccagcaacaacacagggttctggccacattctttccaaagttccggatctagatctctaaatagttctgtcgcttcaaaattccatgcccaccaaatgttgcgtgaaatctcggacaatttctccaactcagccgggatacgtgacttcactgtaacctctttccagttcggagtattcacattactaactttaattttcataatgtttttgtttacttattgataataaaatatttctttagcctaactgacgcttcatggcattgcgcaaggcaatatcataagcctcgtaataatattgaatgaagtgtttccacaatgcctgctctgcaacatctgccgcatgcttacggatctccttcacttctttttccgacttatctgcaaacagcgtaatcgtatctttgatgccatccgccacttccgaatcattatagtccgaacgatgcagcacttccactccatcattgatgccatgctgattcttcaggctgttcacccaaaggccaaaacctgccagatcagtagtaatggtaggcacacggaacgctacactttccagcggagtatatccccacggttcgtaataggaagcatatacactcaaatcctgtcccagcaatatatcataatactctttattcaggataccatcacgcccgtccagatagcaaggcacaaaaatcacctttactttatcatcgggacggttgcccatccccagatatttcagcatatccagcacttggtcatgcgtcatattgtgcagccaatgagtgatgaaaggaacttcaagcggtgtatcaaatttttctttgcttttcagacgttcctgcaagtcttcacggggatctcctacccaaccggggacattgataaacgccaatacgttcttatggagctttttatccctgttcagacggttcaatgactccaggaatacgtcaatacccttgttcttgaattcatatcgaccactggtaccgataattaacgtatcgtcatccagatttgttcccaacaatttattggctacgttcaacatcaatgagcgggcacgtttacgttttccggtaaatgtactgcctttaggtacgaaatcgtcttcgaaaccgttcatcagtactacgtctgccggtttgtcgagcaattccttgcactcgttattcgtgatttcacttactgtcgtaaaacagtctacataatgcgccgtctgcttctcaatagagtgctttgactgcatattcagttcctgcgccatctggtcaccgttataagcaaacagatagtcatacagcggcttatgattgccggctatcgaacgtccgatggaagtagcgtgggttgtaaaaatagtagccacttcggggacagcttcctgtacataaagtgctcccattccggtcatccattcatgtgcctgatataccaccttatccgtttctgtcaggttgtagcggtagaaactctctactacttttccggcagcatacgaaaacatcgaagcctcgtcgtaatcgccataagcgtgcaacgagtctacttgaaaacgattccacatttctgtgtaaatttcgttcttctgttcaaaaaaaggttggaaatcaacaaggatgacaatgggttcaccgggtatattccatcgtcctacacggacggaaagatgatcgtttttgaatgcgtgctttttccagtcagcgcacagattatccgactcgatgaatagagggttctcttttccttgccacacatcaggacctatgaaaaaaattctgtcgcggaatttttcctgcaatgtattcgcccgtgtcgacaatacggtgtatatccctcccactttattacatacttcccagctggactcgaagatataatcgggggttaataaatcttttaccatataatatattaaaactctttttagtatgcgagtgcaaaagttcttttactttatccagcattaaaccttttctttcaagtgtcgtctaatcatcagaagatattatataacatgctatatactatactaaaccatgaataaaaaaactaaatggggcatcattattcttatcggtgccggaattatcggtgggggaatttactcacagttaccaaaaactaacgacgaactggctgctgctgacaaggtaaaaaatacccaaaagaatggaaaaaagattctgaacgtcaacgccaaagtaataaagcctcaactgttaacagacgaatacactactaccggcgtacttctgccggatgaagaagttgatttgtcttttgagacttccgggaaagtaatagagatcaacttcgaagaaggaactcccgtaaaaaaaggacaacttcttgccaaagtcaacgaccgccagctacaagcacaacttcaacggttggtttcacaactaaagttagctgaggaccgtgtattccgacaagatgctctgcttaaacgagatgcagtcagtaaagaagcttatgaacaagtaaagactgacctggcaactctaaatgctgatatagaaatagtaaaagcgaacattgccctaaccgagctccgtgctccatttgacggaatcatcggacttcggcaaatcagtgtcggttcatacgcttcgccgacaactatcgttgccaaactgacaaagattactccgctgaaagtagaattttcagtaccggaacgctatgcaagccagattaagaaaggtacgaacctgaattttagaattgaaggaaaactagatgccttcagcgcaaaagtatatgctgtagaatcaacgattgatcccaacctgcatcaatttacagcacgcgcactttatccaaataccaatcgcgccttacttcccggccgatatacaagtatccaattaaagaaagaagaaatcccgaatgcgattgccattccgacggaagctatcgtaccggagatgggaaaggataaagttttcttgtataaatcaggaaaagccgaacctgtagaagtgacaacaggcattcgtacagatgctgaagtacaaattgtaagaggacttcaagtaggagataccattcttacatcaggaacactgcaacttcgcctgggacttcctgttacattggataatattgactaatacctgccatgccttatgaatatatctgaattaagtatacgccgtccggtattagctacggtactgacaatcattattctcctttttggatttatcggatacagttatctgggtgtccgtgaatatccatcggtggacaacccgatcatttctgtcagttgttcttatccgggagccaatgccgacgtcattgagaaccagataaccgagccactggaacaaaatatcaatggtatcccgggcatccggtctctatccagcgtcagccagcagggacaaagccgtattacggtagaatttgaactttcagtcgatctggaaactgcagcaaatgacgtacgtgacaaagtttcccgtgcccaacgttatctgccccgggactgtgacccgccgactgtatcaaaagccgatgccgatgcgatgcctattttaatggttgccctccaaagcgacaaacgctcactgcttgaattaagtgagattgcagacttgactgtcaaagagcagttacagaccatctctgatgtaagtagtgtatctatttggggtgaaaagcgttattccatgcgcctttggctcgatccggtcaagatggcaggatatggcatcactccgattgatgtaaagaatgcggtagacaatgagaatgtcgaacttccttcgggtagtattgaaggaaacactaccgaactgacaatccgtacattgggattaatgcatactgccgatgagttcaataatcttattgtaaaagaagataacaaccgtatcgtccgtttcagtgacatcggacgtgcagaacttggtcctgccgacatcaagagttacatgaaaatgaacggtgtacccatggtaggtgttgttgttattccacagccgggagccaatcacatcgaaattgccgatgctgtgtacaaacgcatggaacagatgaagaaggacctgccggaagatgtgacgtatagctatggttttgataataccaaatttatccgggcatctatcaatgaggtaaaagagactgtatatgtagcctttattctggttatcatcatcatcttccttttcttacgcgactggcgggtgacgctggttccgtgcatcgtaattcccgtatcgctgattggagcattcttcgtcatgtatcttgccggattctccattaacgtactttccatgcttgccattgtgctggccgtgggactggtggtggatgacgccatcgtaatgacggagaacatctatatccgtatcgaaaaaggaatgagtccgaaagaagcgggaatagaaggagccaaagagatcttctttgccgttatttcaacgaccatcacactggttgcagtattcttcccgattgtcttcatgcaaggtatgacaggacgtttgttccgggaattcagtattgtaatttcgggttctgtcattatctcttcatttgcggcactgactttcactccgatgctggccacgaagttactcatcaaacgtgaaaaacaaaactggttctacactaagacggaaccgttttttgaagggatgaaccgatggtacagccgttcgctcgctgcttttttgcgtaagcgctggctagcacttccgttcacttttataaccatctgcctgatcggtttcttatggaatgctattccggcagaaatggctccacttgaagaccggtcgcaaatctctatcaacacccgaggtgcagaaggtgtcacttatgaatatatccgtgactataccgaagatatcaaccagcttgtagattctattctaccggatgcggaagcggtaacagcacgtgtatccagtggtagcggaaacgtacgcattacactgaaagacatgaaagaccgtgactacacgcagatggaagttgcggaaaagatatcaaaggccgtacagaaaaagaccatggcacgctcgttcgtacaacagcagtcttctttcggcggacgccggggaagtatgcctgttcaatacgtactccaggctaccaatctggaaaagctgcaggaggtattaccgcagttcatggccaaagtatatgagaatccggttttccagatggcagacgtagacttgaagttcagtaaaccggaagcccgtatcagaatcaaccgtgacaaagcgagcgtaatgggagtcagtactaaaaatatcgcccaaacgctgcaatacggattgagcggccagcgtatgggatatttctatatgaacggaaagcagtatgaaattttaggtgaaatcaaccgccagcaacgaaacaagcctgccgatctgaaagctatctatatccgtagcagcaatggagatatgatacagctggacaatctgattgaactggaaaacggtatcgcccctcccaaactgtaccgttacaaccgatttgtatcagccacaatttccgccggactggctgacggaaagaccatcggacaaggactggatgaaatggataagattgccaaggaaacattggacgatactttccgtaccgcattatccggagactccaaggaataccgtgaaagttcttcgagcctgatgtttgcttttatactggctatccttctgatttatctgatcctggcagcacagtttgaaagtttcaaggacccgttaattatcatgttaacagtgcctttggctattgccggagccttggtattcatgtatttcggagatatcacaatgaatattttcagtcagatcggtattatcatgctgattggtctcgtggctaaaaacggtatcctgatcgtggaattcgccaatcagaaacaagaagcaggcgaggataagatgagtgccatcaaagatgccgcattacagcgtctgcgcccgattttaatgacaagcgcttctactgtactgggacttattccattggcatttgccagcggagaaggcgccaatcagcgtatcgccatgggtacggctgtagtaggtggtatggttgtttccacactgcttacgatgtatattgtgccggccatctacagttatatttcgactaaccgaatcaaaataacaaaagaatgaaacagaaaggtatttgcatgaaacgaatcatatatatagttaccgcatgtgtcttcgtatcagtttctactgcgaaggcacagcgaatctattccttaagagactgcctggaagaagggctgcaaaacaattattctctgcgcatcgtccataacgaagaacagatcagcaagaataacgcgacactcggaaatgcgggttatctgcctaccctggacttttctgccggatataccggaaacctggacaatatcgagacgaaagcccgtgccaccggagaggtcaccaaaaataatggagtctacgaccagacagttaacgtcggcctcaacctcaactggaccatcttcgacggattcaacatcagcactacgtacaagcagctaaaagaactggaacggcagggcgaaaccaacacccgcattgccattgaagacttcatcgccgatcttgcctcggaatactacaacttcatccaacaaaagatccgtctgaagaactttcattatgcgatgtcactttccaaagaacgcctgcgtatagcagaagcaagccatcttgtcggtaaattctcgggtctggattatcagcaagccaaagtggacttcaatgcggacagcgcccaatacatcaagcaacaggaattgctgcactcctcgcgcatccaacttaatgaattgatggccaacaataatgtaaatcagattatcgtcatcaaagattctaccattgacgtacacagtgacttactgttcgacgatttatggaatgctaccttatccaccaatgcttctttgctgaaagccgaccagaacactgtactggcacagctggattacaaaaagatcaactcccgcaactacccatacctcaaactgaataccggctatggatatacctttaataaatacgatatcaatgcaaacagcagaagaggcaacttaggctttaatgccggggttactgtcggttttaatatcttcgacggcaaccgccgccgtgaaaagcgcaacgcaacccttgccttcaagaatcgtcgtctggaacgacaggaactggagttagcccttcgttccgatctcagcaacttgtggcaagcataccgtaacaatcttcagctgctgaatctggaacggcagaatcttgtgaccgccaaagacaatcatgatatcgccatggaccgttatatacagggagacctttccggttttgaagtacgcgaggcacaaaagagtctgctggatgccgaagaacgtattctctcggcagaatacaacaccaaactttgcgagatatcactactgcaaatcagcggaaaaatcaccaaatatctggagcaataagacttttattctcctgttttcattgggctaatcatctgataaaagcgattagcccaatttttatgccataaagaacagatattacccttcattcccgaccttttcttctacatttgcacgcaccataacattcacttaacaatagaagtcatgagacaaacagcctttttctttctgttacttttcattcagactggaatttcagcccaagcaacagattacaggaaacaacagaattacaaagaatgggtacacctcgctcccaagttcgatgatgcctttttccggacagaagaagcacaacgcattggagacaatgtattgctataccagcaagtcaccggaggctggcccaaaaacatctatatgccggcagaactgactgagcaggaatatgccaaagcaaggaatgcgaaagaagacgtcaaccaaagtaccattgacaacaatgccacgacaactgaaatccaatatctggcccgtctttatcaagctacacaaaaagagaaatacaaagaaggagtactgaaaggtatccaatatctgctcaaagcacaatatgacaacggtggatggcctcagttctatccgcgtcctacaggatactatgtccaaatcacatacaatgacaacgcaatggtcagagtcatgcagcagttacgggaaatctacgagaagcagtccccttataccttcatccccgatgaaacctgccagcaagcacgtaaagcctttgacaaaggaatagaatgtatcctccggacacaggttcgccaaaacggggaactgacagtatggtgtgcacagcatgaccgcatcacactggagccctgcaaggcacgtgcatatgagttgccttcattgagcggacaagaatctgacaatatcgtgcttctgctgatgtctctcccccatccatcggaaaaagtaattgaatcgatagaatcagccgtcaaatggttcaagaagtccgaaataaaaggagtacaaaaagaatacttcaccaacagtgacggaaaaagagattatcggatgatcccttgcgaggattgccccgtactatgggcacgtttttatgaactggacaccaatcgtcctttcttctccgaccgcgacggaattaaaaaatacgatatctcagaaatcggacatgaacgccggaacggatatagctggtacaataaagacggcaacaaagtactggcaaaatatgagaaatggaaaaaggaattaaataggaaataataccggaggatgcgataagaggggatgtcaaaagtcaatagtaactaaactctcctccttcctgaaggagtttagttactattgacttttgataacctcttacctatttctattttctatgactatcctactatatatttagcaacctttcccgcacgatagatcagccataccaatccccatgaaacagcgaaagcaagaatagcggctacaggtatctgcaaaccaatcggcatatcaatagctctcatcagcacgaccgacggccctgtaaagaaataatgtatcatataaataccgaatccgcatacagtgagattcgccaatgcctttttcatcctttccgagttcactttcactttctttgccaacataaacacaggtatcgtcatcattacaacattaagagaacaatacgtaaagaagagttccagcatctcatccgtatattccggcaatgcggttatatgtctgaaacctaagaatgtcaccgcataaccgactgcaaacatcggaatgccaatcgtcaacgtttttttcaagctccattccagattcttcagataatgtcccaacaacagatagccattgaaaccggcaaaagcatacagcattccaaaagagttccatgaacaggttccccataaataattagaaacaaactgataataataaggaagcagcaaagttaccccccaagccagcaggaacatcagtttggcacgttccgaagccttctctacccaagctgagaaaaccggcaaatacagatacagcccgattagcagataaatataccacatatgcacggctaagatggagaagttgaacggaatcatcaaaatatattccaaagatacagagaatgactgccgcatcacttcctctcccgcatacgggaagaaatcaagaataatctgaggattcagtcccaacaggcctgtaatccaagggaacagattatagagcaccgaccatatcaggaacggataaaagacgcggggaatacgtttcttgtaaaaagtagaagcatcacctcttacaggcagaagcaatgcaccggtaatcatcacaaacagaggcacacacggacgcagtacagatccgtagatagcaccccaaagttttatttctccgatattcggagccgtgccgggataaaaattaaacggatcggtgcaatgacagcagacaactgtaaacatcgcaataaaacgaacgacatccagccagacaatatgctggttcttttgattggataaattcatcacaggtggtttcatggtgttttaattattagataagcaagtttataaaaaaagggatacccatacgaaaactgacaggtatcccaaatgaatgtttatgtaatcaaccgcaagaataacttgccattacttattacttgttacttattacttgttatttgttatttggcacaacgtggtttaatctgtttgaagaagtcatttcctttgtcatctaccagaataaatgccgggaaatcttccacttcaattttccagattgcttccatgcccagttccggatattctacgcactcaatgctcttgatgttgttctgagcaaggattgcagccggtccgccgatagaacccagatagaagccgccatatttctgacaagcatctgtaacctgctggctacggttacctttcgccaacataaccatgctgccaccgtggctctggaacagctcaacatacgagtccatacgtccggcagttgtcgggcccattgaaccgcaagccataccagccggagtcttggccggaccagcatagtaaataggatgatccttgatatactgaggcaaatcttctccacgatccagacgttctttcagtttagcgtgagcgatatcacggccaacgatgatagtaccgttcagtgacagacgagtagatacaggatatttggtcagttctttcagaatctcagccatcggacggttcagatcaatcttcactacatcaccttcaccggcctgacgcaattctgccggaatcaggctacccggatttgaatccagtttctcaatccagataccatctttattgattttacatttgatgttacggtcggcagaacaagacacgcccagacctaccggacaagaagcaccgtgacgaggcagacgaatgatacgaacatcatgtgccagatatttaccgccgaattgtgcacccagaccgatcttgtgagcttcttccagtacttgtttttccagttcgatatcacggaaagcacggccaaattcatttcccgtagtcggcagattatcgtagaagtgagtagacgccagtttcactgtcagcaggttcttctcagcagaagtaccgccgatcacaaaagcgatatgataaggaggacaagcggcagttcccagagtcttcattttttccaccaggaacggaaccagtgtaccggggttcaaaattgcttttgtttcctgatacagatatgttttgttggcagaaccaccacctttcgttacgcagaggaattcatattccatcccttcggtagcttcgatgtcaatctgtgcaggcaggttacattttgtatttacctcatcatacatattcagaggcgcattctgagagtaacgcaggttttcttcggtatatgttttgtaaacacccagtgacagagcttcctcgtcggtatagccggtccacacttgctgtcccttttcaccgtggataatagcagtaccggtatcctgacagaatggaagtacacctttggcagccacttccgcattacgcaggaaagtcagtgctacgtacttatcgttctcgctggcttccggatcactcagaatcttagcaacctgttcattgtgcgaacggcgaagcatgaatgacacatcacgaaaagctgcatttgccatcgcagtcaagccttctttctcaattttcaggataggatttccttcaaactcgcttaccgatacatagtcttttgtaagcagataatactcagtggtatcttttcccttttcaaacatgggttgatacttaaacggaggtgttgccataatttcttattttattacgtaatgttagttagtgaggcaaaggtagtaattaaaaataaagaatgataacggaagaatgaagaattaagaatgaataacgcagaaaggaactatgcccaccgcaacaagaatttattctcattgcagtgagaactttttctcatgcctatgagtattttttctcactgcgatgagaaaattttctcattgtggtgagaattttttctcatcgatatgagaatggtctgagaactttatatcacaataactactgttaatgaggcaactagccaataagccggctttaaattttactcttgaatggacccgattcttttgatcaattcattgccaagcgcagttttgtcctcaatatgcttcaagacagccgtcacaaacgtgttactttcaaaatcaccacgtacttgttcaaagtcctgcttcatttcatcgtgagaaccgtcggctccgaatcctgtcatcgaagacagcgagaactctttgcgggcatcatcatataccattttatcaaggccgactaccgcctctttccacgcttttacgatacggattatgtcttgtgccgttatttcgtccggattcaagccgtaaaactcctgaatcttgttgtaagcccaggtccactcatacgtataataattctcatgcatttccgcaaagctggcgttgatggacttcaaccggttgacagaaccgttttcgatgccatcgagcagacggtctatttcactcttaggagcgatcagtccggacatatccacccattcgccggtaccgatttccgtgtccggtttcagacgctggcgtatttcttcgttactttggaaattaatgccttccaggcgttttatgatggagttacccaaaaacttatgaatagcgatctcataaaaacggataccattatttaaagaggagttcttgatctttgcgctctgataggaatagatttcagatgtttcgccggatacccgcctaagctctttcagaatagaacgtcccttgaacattttctgaatggtgtatggactcagaagattgtaattgatataatccaatcggttcgggtctttccgtttgtcacgtttcggccacttctgagcatcgcgaatggtacccacacttctcagattcactcccggaaccagataagtcgtgttccgttgctcgatcagataagagaaaggaagattggaggtatcggcatgattaacgtggcgtcccattaccagagaaaaggctccgacacgtgccggccataagatataggagtcggaggtcgttttggctcctctttccatggttccctgatggataggccccagtttatacatatggttgctctgattcgatcccgatcccgcattcataaacgagaacataccggcaatcaataaagtcgatttgtggtgagtcaccgtgaaaggtcccgcaaagatggcgcatgcctccccgttctctccctggcagttactgaaaaacaaggaatcggaggctgaatagttatgtcccagtttgcaagactgaccgacaaaacaacgggtcagcatcgttccgtcatctacttcggaaccggaagagataatgaaatcatcacatattactccatgcccgatatgcactggcgctgtcacattactgttgacgctaccgtttgtcaaacggcaagtaccgcagatatggcaataatcaccgatccgtacattcttgatagaccctgtgttcagaatcatcacatgatcacctatactacctaccgcagaagcatgcttgttggaataataatcggcaatcgccttcatgcgattaatcagttccggacggtgacgatacaatgcaagtatgtacgcctggtgtgccgacagtttatcattgatcagcacttcacgtccgcccgtttcattgagcactgtcgcttccaccccattaccaaaggtgcttagcccgtctaccaaaatgatatccacattttcaatgaaggtatcatttccgatttcataattagcaatgtagttttgaatgttttcaatgcagcagttatcccctactaccacattgtgcagagttacatgacggagtcccgaatgttttctgatccctccgggcagtgtaaattcggcatcaaatacgcctaacttcacttcacccgaaaagcgggtatggtgaacatactcacagttaaacccctcggcaaccaaaacatttccccaatcatcagccagacacgactggctcttcaactgaagcacttcgtcctcagtcaatttacgatagtctttcatatagataaaaatagatatgtaccgcctcccccaatcagtaagcggtacattgattattattcttcctcttcgtaagtctgataaagaaaatcgttataggggtacttttgaacatgcaattctttcactcgctgataaactacatctttcagttcgtctatattgattcgttcgcgggcggaaataaagaggcagttgtcctccatctttgccatccacgtcttcatcagttcttcgagtgttaagttttcctttgttcggggggtaaggtcgtccggcgccttctccacgtaggtgtaggcgtctattttattgaatataagtatcatgggtttgccaccgccgccaatgtcggcaagtgtcttgttcaccacttcgatctgttcttcaaatccggggtgagaaatatctactacatgcaccagtaaatcggcttcacgcacctcatccaaagtcgatttgaatgagtctaccaggtcagtgggcaacttacggataaatccgactgtgtccgacagaagaaatggcaggttatcgatgatcactttgcgtactgttgtatcgagcgtagcgaacagcttgttttcggcaaacacttcgctctttgccagcaagttcatgatggtcgactttccaacatttgtatagccgaccaatgcgacacggatcatacgtccgcggttcttgcgctgtgtggctttctgtttgtctatttccgccagacgttctttcaacagtgacatacggttgaggataatacggcggtccatttcgagctgcgtttcacccggtccgcgaagtcccacagaacctcctttaccgcttccgctaccggagccaccaccctgacgttccaggtgagtccagagtcgttgcaaacgtggtaacatgtatttgtactgagccagttctacctgcgttttcgcattggcagtctgtgcacgcatcgcaaatatatcgaggatcaatgaagtacggtctagtatctttactttcagttcggcttcaatgttacgtatttgtttcgcggaaagttcatcatcaaagataaccattcccacttcacgttcttcttcctcttctgtccgtatatattgtctgatctcttccagttttccttttccgacataagtaaccgaattggctgtcggcaatttctgtgtaaatcgtttcactacctccgccccagccgtctcagcaaggaaagccaattcatccagatactcgttcgttttccgctcatcctgcatctgagtaatgagtccgacaagtactgcggtttctactttggcttcggatattataaattctttcattctttaacttctactatataaatctaaatatggtcgcaaatataacaaaaaaaaaagaggacaatgttgtattgtccagccacgataggctttttgttcacctaaatgtcctaaagattgcttatttggatgaatataacgtttatccacattattttcatgcttacgagaattaggggcttttacccgcaaatcaccccattccaaacaggcatttacaatatttaaccgactagctattgctttattacgaaatattcgtagctttgcgaaagaatcgtaattaaacatcatctccatggaaaagttaactatacaagaagaagaagtaatgatctacatttgggagttacaagactgtttcgtaaaggacatcgtatccaagtttccgcaaccggcaccaccttataccaccgttgcgtccatcgtgaaaaatctcgaacggaaaggatacgttaaatcgaaacatatagggaatacctaccaatatactccctctattcgtgaaaatgaatacaaacgccacttcatgagtggagttgtccgcaactatttcgagaactcctataaggaaatggtttctttctttgcaaaggaccagaagatatctacggatgaccttaaggacattatcgaactgatagagaaaggaaaagaaaaataaactgaaactttatcgatatgactccggaacttgcctatttcttaaagataaacgtagccatcgcattgttctacgctttctatcggttgttttttcataaagacaccttcttccactggcgacggaccgctctgttatgcttctttggcatctctctgctctatcccttactgaatattcaagagtggataaaggagcaggagccgatggtggcaatggcagatctttatgctacgatcatacttccggagcaaatcatcgaggcaccacaggaaacaacggccaactggcaggagctaatcccacaaattctgggatttatctactggaccggtgtattacttcttgccctacgcttcctgatccagctgggcagtatcatacgattgcatttcctatgcccgaaaagcacgatacaaggatcacgtgtacacatattaaagaaaggtacaggccccttttccttcttccactggatattcatacatccggaatcgcatacagaatccgagatcagcgaaataatcacgcatgaagagactcatgcccgccaatatcactcagcagatgtactcgtcagcgagattatgtgtactttctgctggttcaatcccttcgtctggctgatgaaacgggaagtcagaggtaatctggaatacatggcagatcaccgggtattagagacgggacatgatagtaaatcataccagtaccacttgctgggactggcacatcacaaggctgcagcaaatttatctaatagtttcaatgttttaccacttaaaaatcgtatcaaaatgatgaataaacgaagaaccaaagaaataggaaggactaaatatctgatgttccttcccttggctgccctgttgatgattatcagcaacatcgaagtagtagctcgtacaacgaaagaatttgccaaagaaatgatggcagcaccggaagaacaaggtgtttcgcaaaccgaactcgccaatggtccggaacttcccgatggaatgacgggagtagcgacattacaggataaaaaaggaatgcagaaaacaaaagaggtagctcctcctccccctccggcacccgttaaaagtgctactgtaaatgattctgtcgtatttgaagttgtagaagaaatgcccgacttccccggtggacaatcagcattgatggaatatctcgccaagaacatcaaatatccggcaacagctcatgaaaatggaaagcaaggacgtgtgattgtgatgttcgtagtcaaaaaagacggtagtatttccgacgttaaaacagttcgaggcgtagacccctatcttgacaaggaagctgaacgagtgattgctgccatgcctaattggaaacccggcaagcaaagaggacaagctgtgaacgtaagatttacggttcccgtaactttccgtctgtccggtccggaacctgcaaaaccggcagaaacacccgaagcagtagcaatagaaaagtttgaagaggtcgtagtggtgggctatggtcctaaagaagccacacccaataatgaaccaactttcaaagtcgtagacgagatgcctaaatttcccggaggacaggagggattaatgcgctacttagccaaaaatataaaatatccgactatggcccagcagaataaggaacaaggaaaagtgctggtccagattgtcatcggaaaagacggtaacgtgtcgaatataaaaatattagaaggcgcgtcggcatggttggacgctgaagcgattcgtgtagtgcggggtatgcctaagtgggaaccgggaaaacagaacggacaagccgttgccgtagaatatacattccctattacattccgacttcaataagcaaaaccgaaaatatcattattcccctaacaagtaaataacagaaaaaaggagcaatcgtaaacgattctgctcctttttctgttttcgcatagataattacaataatatgattacatttgttggagataaaagcctaatcgtatgaaaagattcgcattaatgataagtttgctgctaagcatactttgtatgacacaagctaaagacagaatcgtagaacgtcctccctttttagctcagagttcctcaagtatagagatagacaaaattgtcatgagtgacacagtcaccactgtgtatatcaaagctttctatcggcccaaatactggataaagatcgcaaccggcagtgtactgaaagacaacaatggcaacctataccctgtccggaagggaatcggcattacactggacaaagagttctggatgcccgaatccggcgaagccgaattccaattaactttcccacccattcctcaaaacgtgacttgcctggatttctctgaaggagactttgagggagcatataagatatggggcatacagctggacaagaaaacattcagcaagttcaaactgcctaaagacgttacagtcaccaaagcagaccataaaacgacgctgcccgaaccagtcgttaaatacgccaaagcaattctcaaaggaagaatccttgactaccaaaaagggatgcccaacaaaggcagtctttattttcaagatgtaataagagacgaagctcaggaaggaaaaatccgcatccaggatgacggaacgttttatcatgagatgaatgtcttcatggtcaccccatgcatgatcaggtttccttttggagctgtcagctacttattagcaccgggagaaaccacttcggtcgttatcaatcttcgcgaaaatgcccgcaagcagtcacatctccgccaagcagaaaagccatacggaaaagaaatctattacggaggttatttagccggagtacagcaagagctggctgatcatcctatgagtttcagtttcactgaaggtaatagttatgaagaataccaacaacagattaaaaagctgaatggtaaaacagctgaagaatataaagctcaaatacttgcccgactccctgagttcagaaaacaaatcacacagtcgaaaggaagccctgcatataaggagattattaatacagacctcgaattgtctgccgcactaaagattatcgaaactgaaaggaacttgaaattagttcatatcatgacgaatgggctggaaggagaaaaagcaaataaatactatgccgagactaagattgatattccgcaaggatattatgaaagtcttcaggacttcacgtatatcctttcacctaaagcctgttacaacagcagatacccgatactgtttgacatcatacgccgtataggtatagatgataagattcttaagagtctgagcaatcatacagctgccagttacttaatacaaaatctgaaggcacagatgattggagtctccatgagagatctcaatccacttaacgataagcaaaaggcagaactgtcaacgatgcccgcagcatacaacgacatggctctggctatgaacaacgacctgctgaaacaaatagaaatcaacaagaagaaaacaggattcaccgttaatgagacaggagaagtttcgaatgaagatttattcccctccattatctccaaattccggggacatacgctgttagttgatttttgggcaacatggtgtggtccatgccggtctgccaacaaacagattctcccgatgaaagaagaactgaaagacaaagacattatctacctttacatcacaggtgaaacgtctccactgggaacctggaaaaacatgattcctgacattcacggagaacatttccgtgtgacggatgaacagtggagctatctgcgtgagaagttcagtatccggggcgttcctacttactttgttattgacaaagaaggaaacatcacttataaacaaaccggattccccggagtggacaccatgaaagaacaattgatgaaagcattggaaaagtaagatcatctaatcaaagagtaacaattaactaaaaagcatacaacaaaatgaaacaccaacaactatcaagagcgaacggaacgaaacgtcctttcctcttagcactaatcgcgttcagtctcggtttctgccattatgcggaagctaaagtgcaaccaacggaagcgttcacttcaaatgttgattcgttaatcattaacgataacaacaaagataaagatgaaacaatctatgaagcagtagacgaaatgcctaagtttcccggaggcacccaagccttattcaaatatctgggagaaaacattcaatacccggaagaagtgcagaaacttggtatagcaggacgtgtgattactcaatttgtcatcagcaaaaaaggagaaatcaccagtgtagccgtagtccgcagtttacatccggaactggataaacaagctattcaagccatcacagctatgccaacctggacaccgggaaaaaaagatggaaaagtggtcaacgtaaagtttacccttccaattaattttcacccaacccctgcagctaccaccaaagcaacaggagaacaacaacctgacagtactaccgacaaggtctttatgactgcacaaaagatgccgaggtttcccaaagaacaaggagaactggatcagtatctgaaacagcacattacgtattggaaaaacgcagccaaacaaaaagaagaaggaagagtcattgtgactttcattgtgagaaaagatggtcagataacagatgcacgagtggtacgcagtgtctctccaacgctggatgcagaagctctccgcatcatcagcaatatgcccaaatgggaaccgggagaaaataatggagtacctgtttccgtgaaatatactatccctatcatgtttagactacgataaacaacacaaaagaggctggtttaaaccagcctcttttgtgtttagaataaatagaataagagcacttattaatgcatctctacaatcttagtcggagccatctccacattccggcgatctacctgacgaactacgctggcagccaatgacaagaaagcgcgaccggttaccgtatcttcatccagcgccaccggagtaccattgtccccaccttcgcagatactttgtacaataggaatctgacctagcagaggcacattcatttcttccgccagtttcttggctccttccttaccaaagatatagtacttattctccggcagttcggcaggcgtaaaccaagccatattctcaactagtcctaaaataggcacattcactttatcattcgtaaacatattgattcccttgcgggcatccgccagcgctaccgcctgcggagtactaacaacaattgcccccgtcattgccaacgtctggacaacagtcagatgaatgtcacttgtgccgggaggaaggtcaatcaggaaataatcaagatccccccaatcggcatcgccaatcagctgcttcaatgcgttgctcgccataccgccacgccaaagtgtagcctgatccggatcaacgaagaaaccgatagaaagcagttttacaccgtatttctctaccggaataatcaagtcacgtccattgattttttccgcatacggacgggcatcttccacctggaacatcttcggcatggaaggaccgaaaatgtcagcatcaagcaaaccgaccttgtagcccaacttagccaaagccaccgccagatttgcggatacggtagatttgcctacccctcccttaccggaagagataccgattatattctttacttgcggaagcagtttgcccacttccggacgggctgcctgcttgctttccgttgtaatagttacctgcacatccggtgatacatatgtatggatagctgtttcagcagccttcagcattgatttcatgaacggatcggtcggtttttcaaatatcaatgaaaagctaaccgccatgccatcaatgcggagattatcggcgaccatctccgcttccagcaaattctttcccgtaccgggataacgcaccgttgccagcgcatccaatattaatttcggataaagagtcataattagttcagaattgagagtggaaaattgatagttccacccaattactattattacttgttacttattacttgtcacttattacttatcatttgctcgtttgcagtccgctccgcttgctacggttgtagctacggtacggatcaagttcaatttccacatccggttcctgcaaaactccctcttgcggaagacggaacttgatatatttgatatttaaaccacgatcgagccactgttgttcataataagtcttaatactcagaatatcgtctaccaaatccgaatgatacaaatcttcggtgataaactcgacaggaagctgattggcttctatcatgtactttgtataagtgaacataaagttactgtcggttttcagatggatgattccatccggtttcaggaatttacggtagcgctccatgaagtaagtggaggtcagccgcttggtagcctttttcatctgcggatcggagaaggtcagccagatttcgctgacttcacctgctgcaaaaaaacgttcgatgatttcgatatttgtacgcaggaaagcgacattcttcattcctgcctgcaaggactccgtggcgcctgtccacattctggagcctttgatatcaactgctataaagttcttatcgggaaacatccggcccagtccgacggtatattcaccccgtccgcagcccagttcgagcacaatcggatgatcatttccgaaaaactcctgatgccattttcccttcatgtcaaaaggcacattatccaccgccgaataaggatattcgaacacgtgcgggtaactcgccatatcggcaaacttctctaatttattctttcccatctcattactgattagaacgcaaaggtacttacttttggcgtaaactacaaaaataaatggagtacagattgctccgtactccattctatagaatgatatttattcgcttattagctttctacagttacttctacattgatattaataccgccttgctgagctttcaaatcttcatagaaagcagcgtgagatacttgcacgtagggttgcaaaacgaagaatccgataccgaaagtaaagaggcaaaggatagcccaaccgatgaagctcaaatcaagcaggaacaatttcatcttgttgccttccatcattgccatacttctttcaatggcagcattgttacacaattcaggttcgtctttcagaatatagtccgtcatcgcataagaataatgcttaatgatacccggaatcagcaacagtaatgaccacaggaaagtataaacagcctgcagcagtttagtagtcaagatacgactatattcctgaaatccagcaaacagcactcccaaatcaacttcttccgctcctctgaatacagccagcatcaaaatagcaaaaccgtatgcaacaggcagtccgaccaacaaagaaccgatccatccaataaaaggaatggaagacaaaccaccggcgatagccgaataaataagagcagcaacggctgccataggccacttaccccgaagggcttcacgtgcctgagcacgcaactctgaattttgttttaacatagtaattacgcaattaaaagagattatacttaaagatcaattattctacaatcgtcacccaaccatgtgtatccggttcgtcaccgtactgaatgccacgcaacttattatacagtttcgtgcagatcggtcccggcttgccgtctttagagataacgtatgattttccgttctccaggtcatcgatacgctgaatcggactgattaccgcagctgtaccgcaagcacccgcttcttcgaacgtttccagttcttcttccggtatcgggcgtcgttctaccttgatgcccatgtcttctgccagctgcatcagactcttgttggtgatcgaaggcaggatagaagatgacttcggagtaatgtacgtattatctttaattccgaagaagttggctgcgccgcactcgtcgatatatttcttttcttttgcatccagatagaactcgcaggaatagcccagatcgtgcgctttcttgttggcacgcagactggccgcatagttaccgcctaccttgtagataccagttccatgaggagcggcacggtcgaactcgcggataatcacatacggattggtagagaaaccacctttgaagtaaggccctaccggagttacaaataccacgaacatatattcttcggcaggatgtacgcctacctgggcacttgttccgatcagtaacggacgaatgtatagagaagcaccggtttcataaggcggaatgaaacgttcgttcagctttacaactttcagaatcgcttccttgaaacgttcggtcggcagttcggccatcagaatgccctgacaagtagattgcagacgtgccgcattttcttccagacggaagatacgtactttaccgtctttgccgcggaaagccttcaaaccttcaaaagcttcctgaccatagtgcagacaagtagctgccatgtgcagattgagatgttcatcactgctgacttccagttcgccccatgcgccgttacggaaattgattctcacattgtaatctgtcttcatgtatccgaacgacagattcgcccagtctatttctttcatatcgttatgtattagtttattttacgctttgattcgcaaaaataacttttattattcagactgccgcctttcttgcaacaatttttcgacttcccgatccgcttttgtcagtttctcggtgcaaaaggcaataatttcattggcttcttttattttttcgctcaaagtgtcgatatccagttcgttgttgtctatctgacggactatcttctcaagacgctccattgcctgagagtatgtttcttttttagctgccatatttattgtatttaagatgaataataatgctcatcgagccggacttcggaagtgaaacttcccttagccagacgggtcactaactggtctccggggttcagcgaagcggcatccgtgaccgcttttccgtctttcagcgtgatgctatatccacgactcagcagtttgtcgggagaagcatccgccacacgttgccgcaaaagttccagtcggtgacgatgacgggacaacagggtctgagtggcttgcgccaagtcttttccggctgccagcaaggcaaagcgggcatctgtaagttttcggtgaacaaggttcgggatgcgggtctgaatcatttccagcctccgtccttcctgttcgagcagggcatacgccccttgttgcagacgggcggataactcttccagatgatctgccgattcggtgatccggtgaatcagaagttcggcagcagccgtcggagtcttcacccgggtatgtgccacagagtcgagcaccgtatcgtcccgctcgtgaccgataccggtgatgacgggcaacgggaactgggcacaagcggccgccaagaggtacgtatcaaaaccggataaatccgaagtcgcccctccgcctcgtatgataaccactacatcaaactcgttcacccggtcattgatgcgatccaatgcagccaatacggactcttccacctgattgccctgcatcaacgccggaaacagttcggtatagaaaaagaatccgccagaattgtgctgcaactgatgacagaaatctccgtatccggctgcggtggcagaggaaatgaccgctatacgttgaggaagaaccggcatttccaattctttattcaaagtcagtactccttcttcttcgagttgcatgagtatctcacgacggcggcgggccatatcgcccagcgtataggcagggtcgatatcgagaacagtcagactgtaaccgtagagttcgtgaaactggactgttactttcaccaggactttgatgccggaagcaaataactgtccagtagtttcctcaaagtaaggtttcagcaagcggtagatattactccagatcataccccgtgccttggctacgagattgttgctgcgcgggtctttctgcacaaactccagatagcagtgtccggtagtgttggaacggacatcgctcagttctgcctgtatccaatattcatcgggcaggcattgctccagacttcgccggacaagcgcgtttagctctagtagggaaagagaatccataggcataattaacgataaatgaatgacacatttctataatgagatgcgaatttgatatagcctaacaacgaagaatagcggaccgttcgttattctttgctcatttggtatgctttccagagatccggaatgccataaccgtagatgttgtccggaaaatcggatctgtcgcctacgctgcgcaccagttcgatcacttctttggcggtcaacctcgggcaggcctgccacaggcaagctaccattccgcacatgataggagaagagaaagaggttccgttggccagacgaagattaccgtctgtgcccactatatccgccttgaggccgactgctacgacatccggtttcacacgtccgtcggcagtattgccgacagaagagaacggggccagtaacttcttcttatcaatagcacccacagtcagtacattctcggcatcgcccggaggagtgattttcttccatgagccgctgccagagttaccggcactgcaaacgaggaccatacccttatctgccgccttcgaagcctcccttgacatcagtgcatagtgtccgttcaggtcacggtaacgatagttcttggtcgggtcgtcaaaggtataataacccagtgaggtattcacaacatccacgcccacactatcggcaaattcgatggctgccgcccagtaatcctgctctaccaaatgctcggaagcctcatcctcactgcgaagcaaccagtaggaggcttccggtgcggtgccgaccatgacattcggctgattcattgccatacaagacagtactgacataccgtggttgctttcggcatagatgtccgcttcggggttcacaaagtcgcgtgtcccgagtatgcggatattcttcatcgcttcgattctgtccgcattatgaaatccggcgtcgataacggcaatcgtcatgccctgtcccttgaatccggcatcgtggagaaggttggctcggctcatttcaatctgagtgatagcgggcccatacaggctgtccgaacgctgcggatcattgatcagcgaatctcttttggtaactgccgacacttttccctgccacactttctcggtggaacggacaaaaggcagtttggctatttcatcgatcagcatactgtcattgcaggagactgtaacgaaattatcccattttccggtgacaagcacatggacgcctttctttcgtatggcatctacatacttcttgcataccggcaagtcggtagagtcgatagccagcttctgtctcaacctgcggtcgatggattttctggaaaggaactcctccggttgctggatggaataagtggttgcagccttatctgtgaggctgatccgatatttcaaggtatcggtagaggtaaattgagcagatgctcccaccgctgtagtcaggatcaatgccgctaatactaatcttttcatctaaatctctctatttattttattctacaatttgtctttattctctatgatcaccagtccgatcccccgctgcgaagcgataaacgcaccgccaagtacccgccgtccatcgtagaacacggcagactgaccgggggcaacagccgaagccgtctcacgaaagcgcaccaacaagcgtccgtcttcgagacgtttcacccgacaaggtatcgggcggctgcgataacggattctcaccgcaagattctcgcatgagaacagttcttgctcatctactatccggtcttgttccgccagcatatattccgtctgcagttgttcggcatctcccagcatcactgtattcttctgcgggttgattttcagcacataagcgggcttgcccaaggcaatttccagtcctttccgctgaccgatggtataataaggtgctcccttatgctgtcccaacttcactccttcggagttgacaaaccatcccggaccgatctccgtatccagttccggacattgctcgcgcagaaaatcacggtaatctccctgaatgaaacagacttccatactttcgccttccttagacttagcttcatatcctttctccgccaagtactcacgcacctttattttcgtatagtcgcccaacgggaagatacaccgcttcagtatatcctgccccagccgccataggaagtaggactgatcttttttatcatcatctcccgctacaatatagatgtgcccgctccgctcttccagccgggagtaatgtccggtcgcaatgtaggcgcagtccagcttgtcggcccattccgccagtacacggaatttaaataaggggttgcacatcacgcacggattcggggtacgtccttgcttgtactcatcgataaagttcttcacgatggtctccttaaaaggtatacgctcgtcagccacataatgttcaattcccattcgtgcagccagttcgcgggcatcctgaggctcgtctccccaaacacgcatcgtgactcctactatttcatatccctgctcttgtagcatcagacaggtagcggtactgtctataccgccactcatgccaaccaatactcttttatttcgttctttcatccgaatttccaatcattagaagaatacaaaagtacaagattatagtcagacagccataaaaaaggaaatgaaaagtttgtgtcccctaatgaatgaacaggcaacagccccattgccatcatcagacaatcatttcctactgtctctttaattattcaaaacggtttaaaaatgattcaagatactactgactatcattcggcgcaaatccgtatgatttgtaatcagatgtatgaaagaagcatggaggacttgacaaaccgcttttaatgttgtatctttgtaagtgtaaaccggaagcaaattcaataacattgataatatagacgaaaaatgagcaataataagtattatataataacagattgcaggcattcccactccgggtaatgcttgttggatagtctgatacaagctaagggctgcgattccttatgaattaggaggtttaatttcaagtatcctattcattgtttggtatatttaatggaatgattgttttggtcgttggttaaactgattattatgaaggatttaataaataaatataagaaaatctgctgctttgccctgatttcattgaccgtccactccctgtctgcacagacaatagtatcattcgatactattgcccattgtatgacagaacagtttcgtatctatcccaaggaaaaattgcatattcacatcgaccgttcgtgctaccttcccggagacactttgtggttcaaagcctacatggtcaatgcgtcttctcatattcctattcggctaagccgatatgtatatgtcgaactggtcaatccggagaatgaaacagtgggtagggcaaaagttagaccggatgatatgaatcaatttcatggatatatctccctccccgaaggtctgccaggtggaaagtatgctcttcttgcttatacccgctatatgctttcggaaaagaatcagctggtatttaaaagggaagtctgcatcgcgatggcaagtaattgggagactacgcacttgaaagcttgcagcaaaacatcatcacatgaagaaaatacagaattgcaacttcaactttggaataacaggcaggagcaaatcccgttgaaaaaagtgaaagctgtttgcgataagggaaaagcagtctctgtcaaactggataaagaaaaaaaaatagagctgagcattcgcaataaaaaagtaactcccgacgcatgtgtgcggctggatatgaccgatgtccgaaacaatacttttcgacaatatgccgctatcagtacggggatggaggattatgatgtcactttttacccggaggggggacacttgttggcagatacgccttgtcggactgcttataaagtgctggatgttagtggcaatagcatagatgccaccttacaattgatagatgaacaggggaatgtgatggcagagagtaaaactctgtatgccggaatgggtgcatttacctttactcccaaaagtggaaaaaagtatagcgtgcaagtgcttaataaacagggtataagaaaaatctttgaactgccacaagtgcaggaatcagcatacggaatcgttgtgcagagtcgaaaaaaagatatacagatatccataaattccgctttacattcacctcacgagaaacttctattgctggcgcatgtacgtggaaaaatgatttgtgcgcgatggttactgtccgataaaggcgacataatcactattgcaaaagatcagtatccgtccggaatcgttcaatgtctgttgttggataagaattataatgtattaagtgaaaggctgggttttattccttaccggaagaccattgtgtgtaaaatggagaatgataaaaacagttatggaaaaagaacaccggttcgcacgagcctgttgcttacggatatgaatggcaatcctgtaaagggtaacctttctgttgcaatcacagacaagtccatggcagttgcggataccacacattctattttgtctactttgctgctttcatccgaattgaaggggagaattgaaactccgtctttttatttgcaaacggataatcccgaggctgaaaaggcactggacttgcttcttatgatacacggatggaagagataccgattgccggagattataaaaggaaactttgaaagacctgtaatggagccggagaagtttacctccttatcaggaaggctgaaaaatgagaaaggagaaggtaaaagccgttatgatgtgtacgtgaggaatttggagttcggtcttaatagggtaataaaacttggtcaagatggagcgtttcgagtggatagtgttgagtttgcggaaggcgttcctattgggatgataggcaagcggttcatacggaaaggtgaaaattatgggcgtaataaggcagaaataattctcgataaggaccaactgtatattctgtcagacaaaacagtgccacagccgtttctgtcagaaatatccggtggaattcagcgggatatggtgtatccggttggtatgagtgattatttattaaatcaggtgacggttaaatccaaattactgaataagagattgaccttaagggagatagcaaagtttaaatttaagaatatgtgggaattggttgactatatgggagttaaattcaaatatccatattatacctcaacaatgaaaggatcttgtaaagcttctgtgaagataatgaatgcttgggcatgtttttataaagatatgcctcttgtgttaatgataaatggtaacatgcattccaatgctggaattcttaattatttgtcattgagtgatattcaagttatttctttaaatagtattgatagaaaaaaaatcctaaagccttatttgtatttatgggaatatgagcagcatacttctgttgccattcttgaattagtactttatccaggcgtaatattggatcctttattacatttatgttctattgaacaacgatttaagggctatggcaagcttgatgatattcaaacggatgtttatccctctggaggataccaagaaccagtagctttctattctcccaaatatgataaaggcaataaggataatgcgttgataccggattttcgttctacactttattggaatcctagcttacaaacagattcatcaggagaatgtgattttttattttattcagcagataaggctaccacatataaagtggtaattgagggcttgacagaggaaggagaaatggtgtacgaaacaagagaatttgagataaaatgaaataataaatttaaagttgaaaataaaatgtgatgataatactttaacaaaatgactggaaggagactgctgcctaagattggtatgagatataaggttctctatatactggcatttcttttatgtgccaattctctattcttgcagatagagagtccgattattactataggggataaatggtatgcttccattatccttttattactatttctaatagcaaacagtacttttagtatgtcctctttttcatggagtctgaataagttactgccatctttctatatcattgttcttctatctgatgttgttttagcgatgcatgggatattgcaatatactcatattattccatttcattcttatttaggtcttagtggcagtttcgataatcctgccggatatgccgcttccctttgtgctggatttcctgcagtgttttatatttatatgcattattgttcaaaactaataagggggagtgttattcttgccgggctatgtgttataatagttgttgtattgtccggttcacgaacagggatattaagtattgcggtaatgtgtattgtttgttttttacagaaaacagaaataggttctcgaaagaaatatttgttgttacttttattactatttccggtatttgtaactttgctgtatttctttaaaaaagactcggcagacggtcgtctgctcatttggaaatgttccgcgctaatgataaaagacaacccggttacaggatatggaagtggaggctttttggctaattatatgaattatcaggctgaatattttgcgcgagatactgataataaatatgcgatgttagcaggtgatgttaaacatccatttaatgaatatatattgttggttgtaaattatggtctaataggttttcttctttttcttacttttgtttattttttgtggaaatgttatcgacgtaattcttgtctcgaaactaatattgcaaccgtttgcttgataggcattgctgtttttgcttgcttttcttatccgctatcttatccttttgtatgggtgatgatgatatacagtatatatgttattatttttcacgccggatatatagctaaatatcctcaatggcttcggagaagtatgtgtctgttgataatcggtttgtcattggcggctttcatttatataacccgacatatactctataccacagcatggaaccgcacggctaaattttcattaataaagcaaacagatatgacttttgctcgttataatgagttgttgcctaaattaggagacaattatttgtttctctataattatgctgctgaacttaattatggaaaatattacaatcaaagtcaagagatggcagagcaatgtagtgaactttgggctgattataatttacaattgctgatggctgataattgtataaatacgactcaatatgataacgctgaaaagcatttgaagttagcttctttgatgtgcccggctcgatttgtcccattgtatgaattaatgaagttgtatcagttgaagggggaagaaaagaaaacaattcaaattgcagaaattattttgaagaaaaaggtgaaagtaccatcttctaaagtagaatggataaaagagaaagcaaaaaactctgtaaagtccgtcatccattagtttgactaacattcataatgtctctagtttttttagtaattgtcttttccatcaatgagttcatcattttcaagtcctttgatgaatgctttttctccttctctacttaggtcgattgttttacccaatgtagggttaaattctttccaagtttgctcccagcagttcgaagagacaattaataatatccagaatagtgctctcatagatgattttttagtgtttactacatacaaatgcagtaatttaaaatctcttttactactttttcgtacttttgtgggcttaacataagaatgaaattatgattcagatagaagatgtagtagtgagcttcgatgtccttcgggaaaagttcctttgtaatttggacgcctgtaagggcgaatgttgcattgaaggggatgcaggggcgcctgtagagttggatgaagtggaaaagctggaagaggttctgccgataatatgggaagagctgtcgccggaagcacgtgctgtcattgagaagcaaggagtggtatacacggatcaggaaggtgatctggtgacttctattgttaataataaggattgcgtctttacttgctatgacgagaaaggatgttgttactgtgccatcgaaaaggcttatcgggatggcaagacggacttttacaaaccggtatcatgccatctctatcccatccggattggagattacggaccttataaggcggtgaactatcatcgttgggatgtgtgtaaggcggctgtgttgctggggaaaaaagaaaatgtggctgtctaccaattcttgaaagaacctctgatccgtaaattcggcgagaagtggtaccaggaactggaagtcgcagtgaaggaattaaaggcgcatgatatgatctgatatttctttcatttcctcgactctttgtgtttggatcgtatcagaagaaataataggcagatcatagctacgataatgcaagccggagtaatccatgcctccggatggataataatcaggaacaggcaagtgacaatcacacaggatgccagaattctgagatagagcctgatcttggcaaatacaggatttggggtagtcgttttcataagtgtcctccttcattttcggcaagatagtgattttgaccggaaaaagatttaactgttaggttttattaagacatagaaaagcgccgacacggaggattttccttcgcttgccgacgcttcttcgttgtaagatgtgaggttggtttataaaaacgtaatattaaaattatgtatcgatattcgcatatgttgcattctcttcgataaactcgcggcgcggacctacgtcttcacccattagcatggagaagatgtaatcggcttcggcggcattatcgatgtttacttgcttcagcatacggttgtcggggtccattgttgtttcccacaactgctgggcgttcatttcacccaaacctttgtagcgctgtgtatgaaccgcattttccagaccgccgccataggtatcgataaacttctggcgttgcgcgtctgtccagcaatactcttctactttaccctttttgcagaggtagagcgggggagtagcgatgtatagataaccgttctgaataatctgcggcatataacggaagaagaatgtcatgatcagtgtgtcgatgtgagaaccatcgacgtcggcatcggtcatgatgataatcttgtgatagcgcagcttttcgatgttagcctctttgctgtcgtcttctgttccgatagtgacacccagtgccgtatatatattgcggatttcatcgctttccagtgctttgtgatacatcgctttttcgacgttcagaatcttaccgcgtagcggaaggatggcctggaacatacggttacgtccttgcttggcagtaccacctgccgagtctccctcgacgaggaacaattcgcattttgaggggtctttatccgaacagtcggccagtttacccggcagaccgcctccggacatcggagacttgcgttgtaccatttcacgggcttttcttgctgcgtggcgtgctgtggcagcaaggattaccttgtctacaatcgtttttgcctcctttggatgttcttccaggtagtaagccaaaacttcaccgacagcctggtctacggcacccattacttcgttgttacccaactttgttttggtctgtccttcgaactgtggttcggcaactttaacggaaataacggcagtcagaccttcgcggaagtcgtctcccgatatttcaactttcaccttttccagcatcttgctgtcttcggcgtatttcttcagcgtacgggtcagtgcacggcggaaaccggcaagatgcgtacctccttcgattgtattgatattattgacataggaatgtacattttcggagaatcctgtattgtacataatggctatttcaataggtattccctgcttctcagagttcagatagataacgtcgttgatcaagtgttcacgtgaagactcgatgaagcgtacaaactctctcagcccttcttcggaatagaatacttcactcttgaagctaccgtcttcttcattcactacccgacggtcggtcagtgaaatgcggagacctgcattcaggtatgccagctcacgcagacgtgaagccagtattttataatcatacaccgtttcggtaaagattgtatcatccggccagaattgttggcgggttcctgtaatatccgatacacccacttctttcacagaataaagcggcttaccaatttcatattcctgctgatagattttaccattgcggaatacctgtgtagtcatgtgtgttgacagtgcatttacgcaagacatacctacaccgtgcaaacctccggaaactttatacgaccctttgtcgaacttacctccggcgtgcagaacggtcatcgctacttccagtgccgacttcttttctttttcatgatagtcgaccggaataccacgtccgttgtcctgtacggtgattgaattatcttcgttgattgtcacttcgatgtggtcgcaatacccggccagtgcctcgtcaatggagttatcaacgatttcgtataccaagtggtgaagtccctttatgctgatgtcaccgatgtacatcgcagggcgttttctcactgcttcaagaccttccaatacctggatgctatccgcagaataagacccgttattgggagtgatttgttcttcgctcataattgcctttctaagttataataacagagcaaatatagtgaaaattgtcgagttggcgaagtttcggaggcgaaaaatgcagaataaaagcggaattagtgaatgggaaagtaatctgatattcaatggtttataaacacaaaaggccgaacttaaaagttcagcctgaatgctatatagaattgttatttttctattattaagcgagcttgttgatgtaaagagccagcttagatttcagattgttagctttgtttttgtgaataacatttgttttagctaacttgtccaacatcttggtgatgccaggatacattgcaacagcttcttttttgtcagtagttgcacgaagttttctaacagcatttctcatggtcttaccataatatctgttatgaagtcttcttgtctcttcttgtctgattctcttcagtgatgatttgtgatttgccatttcgactaatctatttttttagttctttattctttttacttgtagcccgtgggggaatcgaacccccctttcaagaatgaaaatcttgcgtcctaaccgatagacgaacgggccatcctgttgttgcatttctgctttttgctctctcgaatcagtgtttgtttctcgattgcggatgcaaaggtaggaacttttttgaaactgacaaacaattcatgaaaaaaatatgtagttttttctctttttttctgtatggtgactctatagtgcttgattttcaataaaatatgagattgcgatttttcgaaaaaaatatcttcgtctataagactatgaataatgtgctatatttacaccttattatatataaaggttaaggagtatagttgtgaattatgagaaaagtaaagtgtttatagatatagccaggtgtattatttgcaccttctgcttcatgtataaatcagaattgcatttttgtatacatgtgccgtcgagtaacgaccctcttcttgtagattccggatgtatgcttttgcgcatccggtaaagctgtttttattactttttcttttcatactcttgtctatatttacttgttcttcagggagtataacaaaaatagcaatcttttttgttgttaacgcctctaaaaagctcccgattgccaaacatttttttgtagttttgttccggaatgataaaaagaggagtgcattatgctgcaaaagacgaaaggaatagttctacatacgcttaaatataatgatacttctatcattgtagatatgtacacggagttatccgggcggacttcttttctcgttcctgtaccccgttcgcggaaggcggcagtcaagtcagtgctcttccagcctttgtctttcattgagtttgaggcggatttccgtccgaatgctactctctatcgggtaaaagaggcgaagtctttttatccttttacctccattccttatgacccgtacaagtcttcaatggcactttttctggcagagtttctgtatcgtgctgtccgtgaagaggctgaaaaccgtccgttgttcgcttatttgcagcattctgtcatttggctggacgaatgtcgcgaagggtttgccaatttccatctggtttttctgatgcgtctttcccgttttttggggttgtatccgaatctggaagattatcacaccggtgattactttgatttgctgaatgcttgtttcacttctactcgtccgcagttgcattcttcttatattaatcccgaagaggctggacgtcttcgccagctgatgcgcatgaattatgagacgatgcatctatttggcatgagccgtgcggaacgcactcgctgcctgacgattatgaatgattattatcgtttgcatctgccggattttcctgcattaaagtcgctggatgtactgaaagaattgtttgattagcagtttatacttcttccactctcaccagtttccagccttggaatactaatgcgatactctttaattctgtagtccctttgtcttgatgaatccattcgcttgctgcatactgtttcagttgtatttttgcattggacagcaatttctctatctcggtgtcagaagcatcccgttttgcatatttcacttcgatacagtagctgtataccatgtcgggaagttgcagcagacgaggttgcagaaagatatccgcatatcctttgttgctttcatattcgggacgggcaatataataatgtgtcaatccgaggtaagccaaaataaaggtttttacataagcttcaccttctatgaagtcgcgaacactgctttgggcattcaagcggtcggcaatgtatgtgaagcaattttcccattctcctttgtatgccattcgtttcattcggtccaccagcttatctgtctccagatataggtcggcggaatctttgtagatgtctgccatgtaaccgtaaagttgttcgcgcactgcccagttggggacgctcagtatgggctcacccatttccattccgctgatggttagcatgccgtaatagtagagtaggcttttaaagttttccggtttgataatgtcttcggctgggaaactgtttgcaatgattccggtagtagaacctttttcaacaatctcttgtacaacgcttgcattttcaccgaaagttttgtctacgtggatgaggtggcgcagcttgttgtagtcggtgcgaatattagcatcgagcatattgtcagggatgtcttcattcagcatataatgattcatgaaatagagcaccatatctgaattgtacatagacggttcctttagtgctttcatggcgaaacagtaattgtcgtaccatggtttcatgatggttattagttcatctgtagtgtgcggtagttcccggtaacttttgtaataatcgatcagagtgcgtacttcttgttcattaaatcccatcatattattaaagataggtgaactgctataattatccgcaatgttgaatccgctagtgagatcgtccattgttacggggcttacgcctgtaaggaagatgcgctcgatcactgaacttgaatagtcttttaccactttaaggaaactacggaagaatccgctgccatgagtgatgctgcgataacgtttattaccataatctaccagaatattgttggcaaagttatcgtactcatcaaggataagatatatcttttgtcccttgttttgggcgctttggcacagtgatcccaataaggcatctcctgtttttaattcatgtagcttttcaacggcttctttccctaacagatgagcgtttcgttctgcaaatccatccattacgattttgcaataggtgttgaatgtttcttccaaacgatccatattggcggctacactactgaaattgagtgtaagcaccagatatttgttgcgatcaggcgtaggatgcttgcctatataaagattaccaaagattttctcgaatttatctttttggttgatgtcgtagtataaaccgagcatgtttaggaaaaggctttttccgaaacgtcgaggacggacaaagaagaagaaggaggtcactttttctactttggcgatatattgtgttttgtctacatagtaatagttttcaagaattattctctcgaagtccgtcatcccataaggtattttctttattgctgcatccataattgctccctctttaatgttgagaacaaaaatagtttattttcctttatgtggcaactaaacaggggtgataataactctcttctaaaaatatgtattacttttgtcgtcaacaaaataactagataacgaccgacatgaaaacaatcgtaaacttaacagcatatattcttattctattaggactttatagttgtaacgatgatgtattcgtcgacgacttccggacttccgataccgaatttactttggacgggaatggtgatgaggtaactattcgttttgcatcctccaattgggatttggtttggatgtatacttacgatagtgactttacccatcaatatgaagtttatgatgccgacgacaatctgataatgagaaaccaggatgtctacctgaaaggattaggtaagattgtgtgcaatgaaaagctgaccgatttcatcattcaacgcagtaaccccaaagagctaaagataacggtgggcgaaaacgtccgtaacgactactttagattcatgcttgtagtgagcaatgagtatgaatcacaagaaatatatgttcaaattactccgtcggacagatatgtgttcgatcatatcacttattctttaaatgggtattctcatgaatggagactggaagaaactatgagttttatacaatctaataatttaggtactccctccccatgcctgttattcccttacaaggacgcccaccatgaagtggtgttcaaaagcgatgaccctgaggctttccgactattgggaggagataatccgacagtagagataccaagcatggaaaacgaatggttgggaatgaacggtgtacaggcgcaatatacgtctgagcagcaagcgctgcctttgcctttccctgatacggagaagaaggagatttctatcccgcctaaaactacccaacgtatcatcgtgctgttagaatgtgagtggttcgaaacggagtacaccctttatgctgttcaccctaagaatgggagacagcgcactataaccggtacgttgcaaagtaaaatgcccggaaaatgttacatagcacgcgagaatatcaaatgagtagaaatatgaataccagacggtctctgtatataatctgcttgctgctgctttcagcagtcggcaacaaattggacgctcagacagtagtgaaatctgtccgacaagcgaatgacagcaccaaccatgccctcatccatcagatcggttttgacgttcgtccgggctatgtagctccgacaaacagtttccttgaaggcgataatgcacaacggcagaaaattgatcggtcactttccctgcacttgaagtatgctttccagttcagcaaagattcctatttggggaggttgtatcctcatgcctatcagggcatcggtgtttcgcataatacattttataattccgctgaactgggaaatccagtggcggtatatgcttttcaaggggcgcctattgtacgactttcatcctgtttgtcgttggattatgagtggaatttcggtgcttctttcggttggaaacaatatgatgaacatagcaattggtacaatgacgctatcggttctaaaatcaatgcgtatatcaatttgggctttgtcttgaactggcagttttatccacagtggaaactagcagcaggggtagacttcactcatttctccaatggaaatacgcgttatcccaatggaggtctcaatactatcggagggagagtcggcattgtacgtacctttaatgccgaagataaggcgtccggagcaattgctcccaaacgtctttacataaggccacacgtcagctatgacttgttggtatacggtgccactcgcaaaagaggattcgttaaagaaggtatccccactttggttcccggttcgttcggtattgtaggtctcaattttgccccgatgtataatttcaataactatttccgggcaggactttctgtggatgcgcaatttgacgagagtgctaatattaaggactataagctagtaggaacttatggggatgatataaagtttcaccgtcctccattccgcgaacaatttgcggtggggttgtctcttcgggcagaactggtgatgcctattttctccattaatgtcggtatcggacgaaatatgatatatagtggcgatgatacggaaggtttctatcaaatattggctctcaaaacttatgttacccgccatttgtttttgcacgtggggtatcagttgagtaagtttaaagaccctaacaatttaatgttggggattggatatagatttcacgataagcggtgaaaggggctgtagttttcaagaaacacttcgcttttgaactatatttatctgaagattagactacagataacaaatagattattagtcaataaaatgaagaaactcccaaacgaatatctatttactcgaaatgtatctttaatacagtacaaaatcatattacatttacccctatcggatataaaaaaaatgtgttttatttttgtatcttttaaataatgtatagctttgttgtcactaatatttgcacaaatatgaacgaaagagaaagagtattggctattaagggcggtgatcatcaagcgtttatagatttgtataacgagtattggagtcaggtttatgactttagccgattgtacatcgctacaattgctgatgcagaggaaattgttcaggatgtgtttgtgaagttgtgggaatcaaggcatttactgaaggaagatgaaaatatcaaaggttttctctttattgttacccgaaacatcgtatttaataaaaataagaagagagtaaatgagaatcttttcaaaacctctgttttggtagcctatggaaacgaaggttattataactccactactgtggaggaagattattgcgcttctcaactaaaaatattcattgatcggttaatcaattcacttcctgaacaacaaagaaagtgtttcttgttgagccgtgaagaaagcctgagttacaaggagatagccgagaggcttggtattagtcagaagactgtagaaatacatatgggtaaggccttgaaattcttgaaagataaggtgaagcgaggctgggagattctattgtcgcttctttcattttagttataaaaataagacattccttctttctcattatttatatagtgtcggaatatacttatcttctttcttgctgtttttagcaggctgttactttatctgtattttcaatagcctcttttcttttcagatagactttctgaagtagtcagattattaatgatgtaatagaaactcatgtacttttggctataatcaggtttggaggctgatagtaataagctttgattcgcaaaaattatttagtaataaaaatagttggaaaaaagtttggtatggcagctttttttgcactacatttatcattcatcgctgtttcaagttaggcgtttccatttgaacagataaatcagacagcattccccgatcatagttattgtatttgaaaacaatgattagaatgtagttttccgatgtgaaattgcaaggtaacataataaataaagctttaattaatttggacaaaatgaaaaaagtactgttaactttaagtttgagtatcgttgcgtcgatgggcagcttcgcgcagaatgaaccttataagaatccgaaacttactcccgaagagcgtgcggaagacttattagggagattaactttgaaagagaaaataggattaatgaaaaattcttcttttgcggtagaacggttaggagtagctccctataattggtggagtgaggctttgcatggtgttgcccgtaatggactggctacagtgtttccgataactatgggtatggcatctacctttgatgatgaagcaattgaaagagtgtatgttgccgttagtgatgaaggacgtgctaaattccacgatgcccatcgcagtaatcgctatggatatggaaacgaagggcttactttttggaatccgaatgtgaatattttccgtgatccgcgttgggggaggggacaggagactttcggcgaagacccttatctgactacccgtatgggagtagctgtagtaaagggaatgcaggggccggcagatgccgaatatgacaaggctcatgcgtgtgtcaagcattatgcagtgcatagtggtcctgaggcgaaacgtcactcttttgatgtagaagacctctctccccgtgatctatgggagacttaccttccggctttcaaggctttggtgcaagaggcagacgtgaaggaagtgatgtgcgcttatcaacgcctggaaggagagccctgttgtgatagcaaccggttgttaacgcaaatattgagggatgaatggggctataaacatttggttgtaagtgattgcggtgctattgatgatttttttgtgaaaggccgccatgagacacataaagatgctgccgatgccagtgcttctgctgtgatcaatggaactgatcttgaatgtggttcgatatattcgcatttggaggaagcagtaaagcagggattaatcacagaagaacgtatagacacaagtttgcgtcgtttgttgaaagcccgttttgctttgggcgagatggatccggattctatcgttccctggagcagaattagtatagatactgtggattgtgatttgcacaaacagatggcgttggatctggcacgtaaatctatggtattgctttgcaataatggcgtgcttccgttggcaaaaacaggggcacgtatcgcagtgatgggaccgaatgcggttgattcggtgatgcaatggggaaactatgaaggtgtaccctcacatacatatactattttggaagggattcgctgcaagataggcgatgtaccttttgagaaaggatgtgagttactggataatcggatttttgaatcttattttaatgagatctccaacaatgggcgtcccggtctgacggctacctactggaataatatgaatttgagtggtgatgtcgcggctacaagtcagattacttctccgattaatctgagtaatggtgggaatacagtctttgccacaggtgtgggcttatataattttactgctgtttatgaaggaacttttcgtccgaaagagagtggagcttatgagttgctgattgaaggagatgatggctatcgggtatatgtgaacggggaaaaggtgattgattattggggagaacatgccagtgctaaaagggaatatacgttgaaagcaattgcggggacagattataagatcagaatagaatatatgcaggcaggtgcggaggcattgcttagatttgatttgggtatttatcgtcatatttcacctgagatggttgtcgatagagtcaaagaagcggatattgttattttcgcaggtggcatttcgccgagtttggaaggcgaagagatgtattccgttaacagtcccggatttgctggcggcgaccgtacttcaattgaactaccgcaagtgcagcgtgatatcctgaaagcattgaagaaagcggggaagaaggtggtgtttgtcaactgttccggatcggcggtcgcattggttcctgagatggagtcttgtgatgctatcttgcaggcatggtatcccgggcagtctggcggattggctgtggcggacgttctgttcggagattttaatccgagtggaaagctgcccgttactttttataggagtacggaccagttgccggattttgaagattacagtatgaagaatcgtacctatagatatatgacggaagttcctttgtttccttttggatacggattgagttatactactttcgatatttctaaaggacgtttgaataagaaaattatatctgccggacaggatttgaattttaaagtcaatgtgaagaatacagggaagtatgatggagctgaagttattcaggtgtatgtccgcaaagtagatgatgcggaagggccgataaagagtttgcgcgctttccgtcgggtaccgctgaaggcgggagagacttgtgttgtatctattgatcttttgccaactacatttgagttctttgatccgactacaaatactatgcgtattatgcccggaaaatatgaaatcatgtatggcaatagttcggatataccttcggggaataaattgagtgtaacacttcggtaataatattactcattaatgggggtgtcaaaagtcagtagcaatagcttgtgtattcacctaccacctccccctgcgggtactcctccttcccgaaggaggagatttaagatactgccgacttttttgtcagccccagtttcgttactattgacttttgacacactctcatttatttttcgggaaattcagtctgggattttaaggacagctgagtgatccttatccttttttatcgttcctatttcatatactgatgtaatggtgcaggaaggggctgtgttgtaatgctattacagactcaggctttctcacagcggatcagtactttttgtccgttgtttaaggtgctggcaaacagataagtgtctccaccttccgacaatttgattcgtttacggagttcggcaaccgtagccggaaagttacgtactgtgatatttgcttttttcaagtctccgagactttcttttagttcttttttattaaggctgcactgactaatgatgtggaaagccctgccgggaaagctctcgaccaacacatcagaagtataaagatgactgttaggatgcagttttttaacaggaaatgcggaggcgatgctgcggaaagctccggctttcaggagtgaagcgttcggctcatagagataattttccagtgtgtcggtatagttgcattcgctgcactgctcctgttcgcgggtgaatacgaaatgctgttcttcctgtgcccccctggtagggagatttacgcaatggatggatatttcttctgccgatgcttgtccgagtatcagtagtaactctttgcattcattattggcagatatgatgtggacttcctgtacgtgttgtaactctttcaatgccaatgacaagtccagcatgggcgagagtttgaccatgacctgttccgctttgttcagtaagagttcttccagttcggctacatcgggttcacagtctgagatggcaaccgtctttcctccgtgctcgttgcggcgggcaggatcgaggaagatgcagtctaccggagacatagcttgcagataactcactccgtcctcgttctttacgttgatatggtttaggttcaggatgggaaagttgtgtgctgctatctcgcagagttcctgctgacgttctacgtaagtggcggatttgaatctggcagcaaggaaagcgcagtctattccgaatcctccggtcaggtccgtcagggagttaccttttagaagggttgctttgtagcgggcggtgacttctgacgaacattgctccagtgacaggtgcttcgggtaccatatatcatccgtatctctccatgatggaatcttttcggcggcaacttgccttcctgctatctgtgtgatggcggtcggcatatctacattcgggtatttccgggcttgcagggccagagcacgtacatcatccgtctgatgttcgcggataaagagctgggtttcgggggagatttgcatcataggttgtttatattcggcgttatatggtggtactcgtttatggtattacgttgtatttcttccgggcttcttcccggctgcagaagttgaaatgccaccattcgctgggcaatgcacggaatccggcggctttcattactttcctcaataatatccggttctgacgttctgtttcggtgatttttccgttgcgtatcagttcgccttcttcggtgatgtgcgcttctactccaagatgatctacctttgtgcccataggcaacggtcgccccagcgagtcctgaatgctgatgtctaccgccaggccgtaattatgaagtccgcctccacggttgggattggagacatatctgtatttggaagttcctttgaccacatcccacatttttctctgtaccgacatcggacgtgcagcgtcgtaaataatgagactgtaagatggatgcagtaccttcagtgcttcttgtgcttttaagagggcatacgccgcatgaggatgcagataggcttcggacaggtcgtcataaagaatttctccggtgaagttatccgcttttgtgtacattaggctgatggcgatgctgttgtccagctccgctatatttattagtctcagagaatccatgtaaagagccatcgggcttttctgatgccttggaatcagtgtactggcggattcatttttctgcgagggggatgtataaatagaatctgcatcaatggagtccgcatgagcaagggatgtacagtcggatgctgtaccttcggggcttgtatctccgagtcctgcgcacatagagtctgtgtacgttatttcggtctctgcagatgtctttgtctccttatgccccgatacgcaggaataccctgccagcagaaagcaaaagacaaataaactatatttcagcatcatcattactcctttgggttttgtgtgccaaagatacttctttttgaatttagcaccaataaaaagccttttttacgctgtttgttggatctatatatcctgcgcgttggacatatatgccctgcgtgttggatatatatcccctgtacgttggacatatatatcctgcatgttaggttactataccctgcatgaacggtaactataccctatatgcaaatatagtctgaataccggcacaccttcttctgtgatttatccggattttcagcggttgatactgactattactttttttagattggccgtattcttccatatttcgagtagttgcagaatacgttcatccgttactctgctgttattgacagacagcagttccgaatatatttccagcagcttcttcagttccttgacaggctgttccggaagttcggcaatcagtgatgtaagtagcagctccagttcccggttgtgtagtgggctgacgtttatcatttgctgttgtatcaagtcggtaagtcttttcagaggtccccatccggtacgttggtgcgaacccagtatcctgccgatacgtgcactgtctatacatcctgtgttgacacggtccgtccatattccggcggcataagaacgggaagtcttgtcggctaccagcatacaactcgcttccagcagataagaggtctcatgccattcgtgccttaattggtggagtgcctctatggtggcttgggtgataccaacttctctcacttcatttagcatcggatcataaatggcacagcggatgcaccatacaaacaatggttccggtgtattgggagccagccatacaaggcggggcagatcgttttgtatatcgtcataacgttctatctgtgaatacatttccaccagtagcggatgcggatcatacgagtgataactcactctctcatcatactttcctttgttgacgatgtggatgttctctccttccggaacattgaaactaagggttgaagatgtccagttgactactttgttgtgataatcagtatatgaatgaggggtttggaaagtccaccatgagaagtttcccgtcagaaattcgcgtgagcttttgctataagagaaatctttaaattcagtataaaccgtctccggtgatttgatcaatcctgctgtcatccaccatgaaggatgggcgaagggagcttgtggtactgcatcttttgctcctatcaagaaggaaaacaaactttggtattcccctttcagttcctgaagaacagtcggaaagtcttgcgagggataattattcaatgccatcctcgacagggctatctgcatatctatatcgtccggttcggcattggcctgctgatattgtccgagtctttttatcagaactatggggtcaataaatgcaggcatatgcgtaggagtggatagcatgggaagtcggttctcgttactttccaaaaggtctaatgtccggtacagtaattgtttgtgaataggaaattccgttcttttattactcttttggcggatggttattctctgcagattgcgatatctccactgacctttctgaagttcgtctttctgcaccattttctcgtgcagggtgctcagttcttttgcttctacagggaaacgcttgattaatagttttgcgtagtcgataaggaacgttgccatcatagaatccaatattccgttgcgtgaacttccgccattgataagtaacttataggcacgttgaagaacaggtgtccattgggtgatatgtttcgcttccagttgctcattccattctaccaacgcattcaggaaaaggtcgaagtggtatagctcattggaatctagtatttggctggccagaaatatcaggtcttcgatggaagtaatttcctgtatccggttgtcttcccgaaggatgggtggcatcggttcatagtcgaaggaggcgacacttgcctgctcgtcaagagtagtcagcaagactttatcggtagataaagcatctgaaacattgtctttcagataagctgccaactcttttttagtgctggtcagcattgtttctgcataagcagagagtgcttctttcaatgtgggcgactctgtttctccaaatgtctgaatcagtttcactatcttgttctgagtagattcgtcgcgactcatcaacccttgtgcggcagcgcaacagatggtatcacgatattcttttttctctttcgccagtttactgagaactcccagcgtgttttgatggacagcttttacgtccgaagcgaagaggacagtggtctgatccagaaaatcatctgtcaggaaccggggatggctgcacagattcttcagaagaccgaggatgatatttatcggacggctatggggagaagatagtgcggcaagcatctccggctgtaatgtcagttgttcttcaacgctggggctgagtgccgtaaacataccggcaaaccagctgcacaggttcttgttaaagttccggttgattgccagcaaagactctttcagtacacgcatacggtctagctttccgttctcggtgaagtgttggaatgtataataaggatatcctttggccggattggcgtgccagttttgcccgcagtcatattcaaacaaataccagatgtgctcgttgattgtaatatcccgcttttctaatacgggggtagtgtggatatagttaaccagataacctgctatcgtctgcggagagggggaaatggtgagaatacccctttctatccagtccatcaatatctcgtagtccatattgtaaaaaccgccaaactccttaccttcaccttcaacgaaataactatccagccacgtgggaatatgccatgcagctatctcgttcagatgcgctgtgtttatcccccattcgtgtttgcgaaattccttgaggggaaaaatcacaagggcggcaagatcaataatgtgatgctgtcccgacgtggcacgcgtaccgtatgtcctttcttccagctggacaaacttattatagtattcttccaatcggctgaggcagggaatgaggctctcccgctcctcctgtgtcagtttctgaagaaaaggaatgatcttctgcccttgctctttttctactatctcggtaagctgtgtttctagtgcagtcatggttataattttgattgaaggatatatgataacaatatccgtgtttataaattagtctactttaaatcaattaagatcacctgaaatgataaaaacctgataccaagcaatattacctattacttattacctgttacctatcacctctctaatgccgtaactacttttttcagattagcattctttttccacatttccaggcgctcgcggactttgtcgtcagttacgcaatgaccgttcatgcgaagcacttccgcgtagagttcgagtaactgtttttgtccggtgaccggattgtcgggcaatccgccgatcaatacagtgagtaactcttccagttgttgattgtgaaaggcgcttcgtttgtatatgctttcatacacttctgtggtgaagcgttttagcggaacaatgcccatattgataattcgtgctactatttctcctaaccggtgattgtctattctgttgttagcgatgccttccacccatagctccgcagcgtatgaacggacggttttgtcagtaaaaagcaggcctccgcccagcaacagtaaactcatctcccggagcggacagtgaaaagacaataacatacgtaaagcattggctacactgcgtttgctctcttcctgcggtgaaccgaagtccatgtagcagttgatgatttgtgcaaccagtggttccggttggttggggaagaagctgaacagacgttccatatagtcggaatcgcctatattgtatctgctgttgatgatcagatgttcttgccaaagctggtggctgttgtgttctgcatactcatgccacttgtagaaatcgagctggagcagacgtacatctgctgcatattgattttctttctgtgccggttctttccagccgtaatttcctgtcaggtaattgtggggcagcgtgttgcaggagaagtttttgaatgcttcgaattcagtatccggctctttcaccagtccggctgcaagccaggcagatggatgattgtacggtggttcgggctgcgtccctttatctaataaaaagagacaaagatgcagatattcattatttaataattgtcgggcgacagcaatggcttcttccttgtcttctaaagcgcagcgtgctatggccagctgaaagtcccatgaacaaggctttgcattcgcttcctgataaacggcgagccgtcgtacaagttcggtggcctggatgtatgccgggctatgtgtcggagtagagagtaaaggtaatgagtcgccttttttgattttacggattacttccagccacaattgtttgataggttcaaaacaggttctattgctgtaagttggctgccagtctgcaagacgcttgaaagcacgttcgtcgtaggctcctctgtttgcgtctattcctttgagtctttcttccaggcgtgcgaagattttacttaggaatccttggttggcagtgtctttttgtgtccataaacgttgatattccagcaggaaagtggcaagaaagttctcgtatactgcccaactgttgataatgatgttggctgcccgttggaatacaggctccatccggctgaaatcttcttcatccaactggggatggaaggcgatgagggcggcaatcgttgtgtctgtttcccaactttcatccatgtcgaacaggcggctgagctggaacagaaaatcttctttattggcaggaaacgggatacggttgtcttcccgacaaatacgaaccttttcttggaaggttgtttcgggaaggccagtttcttccgcaggctgcttcatgaaagaaacaagtatatcctgtacgctctggaacatctcggattggtaagatagcaatgtctcttgcaatgtagaagaggatgcgtctccgtactttgatataaagctggcagctttcttttgcaggctttcatctttcttcaggaatagttggcagagtgggatgcaacacgcttctttcatttcggggtgcccggcaacgatctgctcaaaaatggaataaatagtaagcagtgagtttttggggctggaaaagaaaagagtagtcgcacgctcgataaactcctgatagcggaacccgccttcggaagcaatcttttttaattgctgtaacatcacattcaccggtttggtgtatggagaggtgaacacttgcatgatttcttcttgcagggatatgagttcttccgcccttggctgcaattcttcaaagagtccggcaaaccaatttaccatgtcttttttaaaacttcggttgaaggtggaaagtgttgctcgcagaagccggtttctgtccagatgtccgtcgagcgagaaacgatagagaattgcgctgaaactttcgtcctgcaccgtaatcccttctttataagcacgcttggcgcaatcgtccaggtagccgagatttgattcatattcgaagacgtaccaaatatgctcttttaaggtgatttcccgtttcagcagtgggctgctgtcgaaagtctcttcttctttgctgttggaagatcttattctgatctgccaggggaccatttgtcccaagagcttcggagaaagctcttttatataccccaaatctacgagctgcatgagttcttgatagtttaggttgaagctatagaatgagtgatcaccattaatgaagtcggataaccaagtggggcggtaaagctggagcagtttgcagagtagctcaaaatctatttcgtatgccatggtcatctcacgtttattggcacttataaactcaattgcggcaagaaaacgccttcgggcagggtcgcagcaagtcatccaaccttctcctctttcatattgcagttctccgatagttggaatcactttccgtctttctttcatcgggagttctaataatcgcttgataaaaggaatcaatatcttttcttctttctccggagtatccacataagttttggctagtttctccaattcgtgtttcagttcttccattgtactcgttttttgactgctaaaatatgtttgcaggctccccgttctccctgattgccgctaaaccaggtacaggtgcagcgttctttctcactttccctgtccagaataaccgtatgtcttactcctccgctcccagcgacacgtgcttcggtccgatttccgtcatttgatataatttccactttctcttcttccaatagcttctcggcagctatcatacgcggattgaggctcaggatacgctctgtcttaaagggcaggcgacgataaaagaaactattatcatccagatcgaagcccagtaaccccatagctgccagtcgtgcagacagagaatccaccttatcgagatcaatgtgctcctcaatagcgaaaagagtggggttgaactgctggttggcgtaactgtatttatccatcgctgctatccatttctccgggacgtcttcaagcagggcgtccaatgccgcaccttctccggagaatccgcgccagcattcccgcgacagggaaaggctgaaacgaaccggaccgaaatagagttgccaaatggtcgattgcatcgtcggatggacaaagactctcagctcgtcagcaaacggcaacaggggttcgagcaggcgcagacgatgtacccctccgatacaaacggcattcagacttttcaccggtgaaaaggcaggtttttgtccgcgcatcaccaaataatagtcacatttcacggttcctttggggagtgtctgaaagagttgcaaagtctgtatacgattgaatgaatacatccgttcggcaacagactggtaaatctgtaccgtggtcagcccctttatccattttacgggcagcggtactttgcgttctattactttttcacctttattgtaaagccctacctccttaggtccgactgacatcactactttttcttgtttgctgatgcttcccagtgcagaaatcataccggcattgaagtcaacattcgttgttccgttctccaggaactctccgtcgtgtccgtcgggcagtacatcgactctggcatatacgcctgcacaattcgaaaatccttcgaagcgtaaacgttcatttcctgccgtcacaatcgggtctttcagcatggaaagctgggcaggagtcagattaaaactggattgtaccacgttggacaacgcaatgaggcagcgtgccgtcatataaggttgtgtcagcttcccccaaaagaaacagggagcttctttcttttctatttcactgtattttgccagaaataattcgtcctgatcagacgaacgttgtaagacagacggagcagcgtattgatatgaaatagtatcagtcatagataaatatataagtgcttgttggacatttcccaaatatagaaattaaatctcagaatggaaagttgttgagtagtttactctgtttgtgatgctgggattgtgattttataaagtgaaatattttaggttgtttgcttcgcttttgcgttttgaatgcgaaagtcagtgtttgcttttatggattgttttttgtttcagtataaatgattttttactgtatattgctgataaataaagagttgatcgataattactactccatttccatttctaactattttcagaattactttaatttgttttgtcatagttgattaatttaattaaccgatatttatcggattatcgatgttccggttgcctaaaaagaaaaaaggacgcaacactatcttttctctatttttcggttaggctctggtaagcccggaatcaaaataggtaaaacagtctgcgcccttagagggtacaaacctgcttcgaccaatattttagattccttgtttaatttaccagatttaaccgaatcaaataatagtccgcaagttatgctatatgtctttaaataatctatttcttttttgctgtttctttagttcatttacaaaattacaaaaactatttgaatcaagaaataaatcgataagatatatcgcagactgttatgttcgcaaaataacaaccatgatatgccaattcgtttcacaggatgcttgtttttacagaattatgtgtgtctttatgaggcggtagtttacgttgcagggcaaaggttgtgcaaggcttagaacatataagatttctggtaaaatactctttggatagagtacgacagtacgatttttatcagaaccgcttgcagcttggtcatgtttgttcgttaagagttcggaacaaccttagccccttcaacgaaaatgcctgactccacttttctctgattatcgcataaatcgctcttttacaaccttctttctgagctctgcttttagtctcgtttttatttcttatctttgttcgttatataataaatagataaaagtatgagtatcgaattaggaaaattcaaccaactcgaagtggtaaaggaagtcgatttcggtttgtatctcgacggaggagatgaaggtgaaatcctgctgcccacccgttatgtacccgaagactgtaaggtaggggatatgttgaatgtatttctttatctggatattgacgaaagactgattgccacgacactgactccgttggtgcaggtagggcagttcgcctgtctcgaagtctcttgggtgaaccagttcggggcattcctcaactggggattgatgaaagacttatttgtacctttcagtgagcagaagatgaaaatgcaggtgggaagatcctacgtggtccatgctcatgtggatgaggaaagttatcgtattgtagcttcggcgaaggtagaacgttacctgtcgaaagatatgcccgattatgctccgggtgcggaagtggatattctgatctggcagaagacggacttgggtttcaaagcgattatagacaataagtatagcggattgctgtatgaaaatgaaatattccgtgcattggagaccggtatgcagatgaaggcgtttgtgaaacaggtacgcgaagatggtaaggtggacctgatacttcagaaaccgggatttgagaaagtcgatgatttctcgaagacactgttggagtatattcgggaacatggcggacggatcaatctgaacgataaaagtcctgcggaagatatttacgatacctttggtgtcagcaagaaaacttttaagaaaggtgtaggtgacttgtataagaaacgattgatttctttgcatgagaccggcatcactttggcagaatcctaaacagaatagggaaatccctatgcaggaatagagagaatcattggggtggggagttttctcaccctatttttgtgatatcagttaaagataataattttaaaaacagataagctatgcgtaagataataataagtttctgtattttgctcgctgccctttctttaaaagcgcagcctgtcagcggaatccggattgatggcggagatactccgattcttgtttattttggcggaaggcagatgtgttatcctactactacttgtttcgttgccaatctgaaaccgggaaattataccattgaagtgtacgcttcccgcccgactcgcccgggagaacgtgtatggaaaggagaacggttgtataatgaccgcgtttactttaacggaaacgaagtaaaagatatcattgtagaagaacgtggagatatccgtccgggcagacccggaagaccgggaaccggtcagggtggacaccgtccggactataaccgctacgatagagtgatgaatgaccaacttttcaagaagttctttgatagtgtgaagaatgagccttttgaaaaagatcgtatggggttgattacaactgcattggcgaactctgattttacatcggagcagtgtcttcaactggtgaaattctatacctttgataatgaacggctgaagattatgaaaatgatgtatcccaatattgtagataaagaggctttctttacagtgatcggtactcttacattctccagtaacaagaccaaaatgaacgatttcatcaaggaatacgaaggacgctgatcatacattagttcactaaaaacgatacggttatgaaaaatatacatataatcctgtttttcacgttgtgggtaatactcggtagctgttctacttattacgtatccaacaagcaagtgatggaggttcagcagggaatgtcccggcagaatgtagaaaaaatcttgggtaaaccggattacagacgttttgacggaggtggcgaggaatgggagtaccaccggatttcttcagtgctttacggcaactcgatcaagattattgtatattttgcagatggaagagttacgggtatggatacctttaatggtgatgaaatacttcttccgccgcctccggttgtgatgtctccttccgttgttgtaaccaatacggatccggttcgtccgccacgctatgaagaaagtccccgtcgcagaacacttatgatgcgtgatgagtttgatcgttttcttagtgatttccggatggtgatcatgtctgatgagcagattaaatatatagatgacgttttgttggattgcaattttacttctgcccaatgcggaaagatcattgatcagataagtggttcggatgcccagatgactgtgatgaaacgtatgtatccgcaaattgtggataaagaaaattttgcttcggtcgtcaataagctcttttcgtcttttgaccgtgacaagatgaaggaatatatccaggcttaccacggtgaccaacgaccgggagacgtaggatatgtacggcccagagctatgagttcagccgattttgaccgtttcttcaatgaatatagaggtaaatcttttgagtctgaccgtaccaggatgctggatgaagttgtacctccttcgggattcacttgtgcccaatgccgtaaattggtggatatgtgtacttttcagacagataaaaagaatatgataaagaaactttatccgaaaatcgcagataagaagaacttctccatactgacggatgttttcacttttgagatggacaaaagagagatgagggagtttgcggaatcttacgatagcggacgtaactaaaaaagaatgaaaccatgaaaagaattctatttatattgttagtcgtgactgccagtaccactgtaatggcgggaatgagtaccagcaaggtacgtaaggagacacgtttccttactgataagatggcatacgaactggacctgaataatccccaatataatgacgtgtatgagattaactatgatttcatttattcgcttcgtaatattatggattatgtagtacggggtgatgagtgggcattggatgattactatgaagcgctggatattcgcaacgatgatcttcgttgggtgttgagcgatgtgcaataccgcagattcttgggagctgagtatttctatcgtccgatttatgtcaccgggggaagatggaatttccggatttatatcaattatccgaatcgtagtttattctattttggtgtaccttatcattatcggacttactgtggtgcacattatcgtccgcatattcatcatgtgagttattatcggggaagatataataatcttgtgcactatcctacgccatatcgggtaagagatcagcgggtattccattcttatcgtcgttcagacttcggttctgtacgtttccgtccgaacacttctgttcgtccgcataatgcacctacccgaccggggacttcgggacgtccgggaacaacgtcacggcctaatacatcgggacgtccgggaaatacttcccgtcctcgtcctgaaacggaccatagaccgtccacttcaggcagaccatctacatcgggcaggccgtccacttccggaagaccttccaactctgaaagaccttcggtcaatgaacgaccgtctattccaagcagaccgtccactccgggcagaaatgataaaccgaataaggaagtaactccgggcagaggccacaacagaggtgaaggagatcgtcattcaggaagtcgtccgggaacgagtacaagtactccgaattctaatcgtcgtccggaaacgaattcagggtcttcgaattccagtcgccgtccgacaagtagtggtacgagcacaaaccgtggcagcagctccggtaggaacagcaattccggcagtagttccagcagagggaacgtatccggcagatcaacagaaagaagctcatcttcagaaagttcgagaagcaacagcaaccgaggttcttcttcccgttcttcagaaagagaaagcagctcaagaagataaaacctattcctttattaataaattattgctcctcagcggtaggagaactggactccggcgtttcgccgactagactattcagggcgtcgcccgtaacttggatatcggggcggatactatccgcctcgatttcacttattaaccctttcttggcgaggcgtccggcaatcagcttataatagccttccatattctcttttaaccgtccgttttccgcaaaggaactgcggaagtgtttaggcttcgggataatagaagctagaaaaatactttcttcggtcgtgagttgcgaagggcgtttgccgaaataataggcagaggcttcctgaataccataaaccagcggtccccattcggctatgttcagataaacttcatacatacgttctttagaagtcagcctttctgtctctatcagccatacgatgagcgcttcttccaatttgcgggcaaagttcttgttccggttgagaaatacgttttttaccagctgcatggtaattgtgctgcctcctctggcgaaacgttcgacttgcaggtcataaatcaaagcttcacgcattgcatcaggcaaaaagcccttgtggtagaaaaaagctccgtcctcactttgcatgacagacattcgcagcaatggagaaatgctgtccaaaggagtaaaatgttcccatgaaggtccgacaggaaatgttttgaccggtattccgttttcataggcggtatagataaactcttcactcatttttgaaagagatgttgcaccatattctattatccgaaaatctttttctttcaattcggactcaaacttaaggctgtctagtcgggcaaaatctatatctaacagaaaatgataagccagctcaccacttgtttttataccttccagattgctgaataagcctttgggcaaagaactgaatagttcgtcggccggaaaccatgatttatctgtggcagcagtgaagtgccattgattttcattcttttctgcccgcagataaggatgaaattttatttggttgaataataccgtcgtcgtactgtccagttccagcgtttgcttgccgatattcatctgatacgtgagttgtccgcgatccagatggatcacttcgggagagagtgctttgtgaaatacatcaagtccgtttactttcgccgtaccgtcaagttgcagttggttttcggtacgattttctttagtcatactataatataaggtatcgaaagtaacttctgctccaaaacggcggttgatatacggtagtgaaactttcttttgctctgtggcaaaaagttctgcctgcagggtatgtacctttctgttcagttctcctgctactttccattgttgagtcagtgtatcttcttttattttgatagtggactgaaagcgattgttttcgattgtaaaggtggggatattgactgttacgaaattgctgtcttttcgttcggttatattaagttgagtcagttgaccgttttcggggaagaaaccatatattaagtttaatattcggttgatgcgatgggcgtaattggtttctatgaccggctctgtggttgcttctgggtggtgtccggagaatagaaaatcatagttggctgcactgtcccgtttgataaaagcgattgccagtccattcatgtggacgttgcggacttcaatatttcctttcagcagtttccaaaaattcagtctgacattgacagattgtagtgtaagaagggtatcccgttggttgggaacgatggaaagcccttgcagggtaatttcgctacatcccttcatttgtagattctgataatgaatttgcagtccgtatgtttgttcgatatgagtcgtacgcttgttagttatgctttgcagaagcatattgcggctcaaatagatactgataaggcagataaacaagcctcctccgattgatagaagaagaatactttttttgctgttctttttcatcttttgcctttaataagttattggctgcaaaggtagataatattctgttcaacaagatataagcagtctttttttattagtgtgtccgattatgagcgtacaactgttcattttcgtacatctcaatttttcttctttgcgctgactattaagtatttatctttttggcatgcccattgcatttatatattcgaaggcgggcaacaaaagaaatgaaaaaaaagttcagatagttgcaaccattccatatagacgttccgtctaataaacagaagaacaaaaaaagaaagttgaactaataaaaaatatacaattatgaaaactacagtattattcagaatgatggttttagtggcaatggtagttgccggtatcgccaatacagagttgaaagcacaggacaataacttcattactaatgaagagaaagtagatgatcttgttgtttcgaaggtgatttacagactggatggttctctctatcgtcacatgaaatatgattttacttatgatgatcaaaagagagtaacagctaaagaagctttcaagtgggattcatccactgaaaaatggattccgtatttcaagatcgattatgcttattcttctaatgaaatcacattggtatatgcacgttggaataattctcacagagcttatgatgattctgtagaaaagagtgtttatgaactgaatgatgctaatatgccgatcgcgtatatgaactacaagtggaatgactataaatggattgaagaatcagccggcaactgggctatgaatatacagactccggtgacagatgaagcagacttgctacttgccggaagataacaataccggggattgtgaaattctctttctctcttaaggttttaacaaacgaaaacggtggattacccaaacgagggaatccgccgtttttattgtatctgtctgaaaccggtgctgtttactaggttgttctatttaatgagcggcagatattctccatatccttcttctttcattttttctttcgggataaaacgcagcgaagcactattgatacaataccgcaatccgcctttgtcctttggcccgtctgtaaatacatgtcctaaatgcgcatctcctgtcttgctgcgtacttctgtccgtatcattccgtgagtagtatctttcttctctgcgatcagctctttctgaataggtttggaaaaactgggccatccacaaccggaatcaaatttgtctgtggaaacaaacaacggttctccggtagtgatatctacataaatgccggggcggtgttcattccagaactcattatggaaagccggctctgtggcatttttctgagtcactgcatactgttcggcagataatttcttacggagagtggcatcgtccggtttttgaaaagttgggggcttgggagcattcgcttttcgtgccatttcaaataaagccagattgatatggcaatatccgcccggattcttatccagataatcctgatgatagacttctgccggataaaagtttgtcaacggttccacttcaacggcaatcggtttgttgtattgagtggctaatgcctggatcgcctgattgatggtggagagatcggctttattgatataatatataccggttctgtactgtgtaccacgatcgttcccctgtcggttgaggctggtcggatcgattgtctgaaaatagaggttgagcaataaactcagatttacttcttccggatcataaacaaccttcactgtttcggcagcatttgtcttgcccgaacacacctgttcataactgggattggcaacggtgctgttggcgtatcccacctgagtactttctactcctctgatttgtttcaggaagtgttcggttccccaaaaacatcctcctgcaaaataaatttccgcttgacttttcattggttttgcaattcctaaaaatacattactaattgttagaatcactgcgatgattatatgtttcataactgttggttctttctatagtaacggatgaaccggtggatatgttttagaaatctcttacataaataacaagtgcttttggggaagtttgaaaacatgagtaaatccttaaaaatagaatacgtttccgatgtattctatttttaaggattttgataaatagctggaaatctgttctattctatgatttctcctttgtagaaatccagtattttagtacggaatagataatcgtatttagcttgcagtttatccgacagtgctttggtcaggtttagtttcgcttcattgtattccacaaaagtagctttaccgttattgaatttttcgctcatcaaccgaaaagattcttcgttggctttcactgcaacttcgctggaggtatatttactttctgcagctactgcattataccaggcttgctggatttctttataaagtactttcttggcgttatccagctgcaaagcaaggtttgactgttgtaggcgggcagtgcgtacccgattacgagtgctaaaacggttgaagatcggaacgctcaggttgaaagaaatagatttgctcaggttattttttaattgacgggcaaaaccggattctgcttcaccgttgagtgtatagtagctgcttcctagccctgcactgaaagaaagttgggggtagaattcactttgagcgatacgaatgttttttaaactaccttgtaagcgatattctgctgccttgatgccgggcttataggcaatcgcctggatataaatgtcatccggagctgttagaggttcaaatttcagttcttcttttggattctcaagaacgaaaccttccggtgtaggcagttctaataactggctgagacttaataatgacaatttatatgtattgtctgcctgtacggctgtcatctcatcctgtgctacacgtgcctgcgcttcagctacctccgccggtgaagccttgccgacatcatgcagtcctttgatacgtttcagctgatctttgcttaactcaacctgattttgtgctaccttgttcaattccagattgaaaagcacttgcagataggcagaggtaacattgattgcaatatcctctttggctttattcaggtcctcgatagcagcctgtaaattgagcttggcaagggaatattgattggataattgtaagcctgtgaagagaggtacattagtacttaagttcactcccgtactggaactgttagtatcactatatgaattatctttcggagaagctgtacgtccccagctccacccctggctgataccaccatttaagttcggcagacgtgcccatttagcggtgtttacactaatcttattttgttcggcttcattggctgtctggcggatgtcgatgttatgctcgatggcatagtcgatgcattgccgtaaagtccatgtctgcggagtggtatcctgtgcttgaacagaaccgataccggttccgctcaacaggatgattgccatcattttattgattactttcattggatgtcagttatttatcttttttctcagcaccgcgtaacttggtctgagcggttacacctttttttatctcaatcttgataccgtcactcattccggtagtcacttgtgtacgttcgaatttctgttgtggtacggagtccgtcatgatatatacaaacgtagagtcaccgctgaactcaatcgtactttcgggtactgccagtactttgctggcacgctggagcacaatctctgcattggcggaatagccggaacgaatctgcacggtatccggaactgtgatagcagctttgatttcaaattgattggctccgttggtttctactcctttcggtgaaatatattcgagaatagcatcaaaagtcagattctgtaaagctccgatcgtcagtttaatcggcattccctcatggatgcgacccacttcggtttcgtcaatatttcccctgaaaatcagatcgttcatgtttgctaccgtagcaatggtagtaccgtcgttgaatgtattactcatgattacggagttaccggctttcactggtacgtccagaattaatccgtcaatagtagagcggatcatggtgctactgaatgaagcactgtttttagtgattccttcttttataatttccagattatctttggcagtctgattctcttcccgtgcctgctttaccgctacttctcctttttcgtaatcttcacgactgataagctgatcttcatataacttcttgatacgggtaaagtctgtttcggcctgctttgcattgatctctgccaggcggacacgactttctgcggagttcagttgtccgagttcgggaattactttgactttcgcgatcacttcccctttttttacgctctgtcccgcttctttgaatacctcgtctacaataccggaaatctgaggcttgattaaaatttcatctctcggctctacctttccggtggctactgtagtcttttcaaggtccgtgacttctgctgccagtgtttcatatacgatcactttaggcttggatttctgataaagaaatacgaacgttccgacaaggattatggcaataattaccaataatgtgattttcagatactttttcatcttgaatatatatgtttaatttttaattcttcatttaactctcaactttccacttctactcatctctgatcgcttcaatcggtttgatagccatcgcacggtaagcaggtgccagtcctgccaacatacctaatgcgatcagcagggcacaggttccgactgctaatccgaagctgacctggaaatgagcatctcctccgttggagttcgctcccatctcaaccagttgcagcaccatgacagcgaaagaaattccgaacatgccggcgatggttgtcaagaccatgctttcagataagatttgctgcaggatgtctttggggcgtgcaccgatggcacggcgtatgccgatttctgtagtgcgttctttcactgtcaccatcatgatattcgatacaccaatggcgcctgccagcaaggtacccaaacctaccatccagatcagaatatggataccggtgaataagttgtctaccatggaaaacatagcctcagcgttcagatacataagcgcctgcttgtcattaggagcaatatagtgtgctgccttgatgatttcttccatttggggttgtacatcggaaacctttacgccccgtttgacggtgaagcagattacatcaatttgtccgcccagattataagtctgctgcatggtggtgaatggaagggtaacagcctcggaggcacggccctgtatgttcatatctccttcggaagaagacatgccgatgacttgatagtagatgccgtctacccgtacatatttgccacacgggtcttctcccggtttgaacaggctttcgtaaacacgcttgccaataacgcagaccttacgcgcttcacggatatctacgtcgttgataaaacgcccgtatgccatttcttgtgattcgatatggagatagtcgggatataatcctttcacactacaatcgtattccttgtctccataaatagcgttggatccccaacgggcaacggaaggggtgatgacttccacatcctttacctgcgagcggaggcgttcgatgtcgatggcttccagatcccaccagcgtcctttacgaaatcctttgtaggcttctcccgttttttgggcggcaaggaagccggagttggtggcaaatccctcaaagttcttttgcatcatatcctgcaatccctgtccgccgccgataagcgccacgagcatgaagattccccagaatacgccgaatgccgttagcaggcttctcgttttatttcttgtgatggtgatgaggatttcctcacaagtatctatgtctattctcataatctttaatcggctctaagtgcttcgatcggtcggatgctgactgctttgcgggcagggaacaatccggctaatgttccggctattactaatgtgagtgtagcttggatggcgattcctatgtcgaccgttggattcaggaataccgtttcggaccatataccgttgtccatagtctggttgccgaaggcattgttcatccattcagtggctccaatacctgcaaccatacctatatatccgaatatggtggtaatcgtgacgctctctacgataatcagccaaaggatagaaagtggtttggctccgagcgctttgcggatgccaaattctcgggtacgctctttaacggtaatcagcataatgttcgaaactccgacaattccgcttaataaggtgaaaatgccaatcacccaaatggcaatacgaagcatcgccgatccttgctgttgctgcagataattggtgaaacggttccatatccagatggcgctatgatcggtcgggtcaaaacgctggttggcgccgatcactttacggtagtgggcttcgaattcctcgttagattctattgtttccaaattcttggtggtcatgatgaggttattcagcttgtctcctttattataaatcgtttgcagggttgtgaacggaagataagcatcgctgtctccgctgtcacctttgtcattgtacagtcctactacctgatagacaacattgcccgcattcacgaattgtccgatggggtcagtatgtgttttgtcgaacaggatttcggcagtctttttgtggagtacaattactttccgtcgttctttaatgtcgatttcgttaatgaaacgtcccttgaaaagctttactacttccacttccgtatggttgggatatactccggaaagattcaggttgacatattccggtccgaagctaaggttcacacctccctgatatacggttgctccggccttgatgacatgatccggaaaatttttattggtcgtattcaagtctttgttatccagtcgtatccgccttccttccttcagaccgtcgtatgatttactggtccatcccggaaaaattttgatggagttcatggcccgttccgaagccgactgttcgaatgcgtgaatcagcccgttgccggcacccagcaggacgatgagcataaatattccccatgcgacggcaaatccggtgagaaaagtcctcaacttattgcgtttgatggtactatatatttcttgccaaatatcaatcatattttaagtaataagttataagtaataggtaataagtaataggtaataagtaataggtattaagtattaggctgcgctgtgaccgcatggaattaataccataagctatatattttagaggcttaacaataactacttatgatctatgattatgcaagaaaggaaaaaataatgaaaatatgaaaattccgagtttaattagtgttaatctccagtctatatattacttaatccattttcaaggcaggtaggtgaaaagagatatattatgggagatattttaggattataattgtgttcatctaaagattttgctatttttgcaacctaattattctaatttatcacctttgctaactaaaaaactttcaatatggatacgagtaagattgttggagagaaaattaaagcgctccgggaagataaatcaataagtatagaggaattggcacagcgttcgggtttggctatcgagcagatcgaacgaattgaaaataacatcgatataccgtctcttgcaccgctgattaaaatagcgcgtgtgctgggggtacgtctgggcactttcctggatgatcaggatgaaatcgggcctgtggtatgccgtaaaaaagaggctaaagatgccatcagcttttccaataatgcgattcattcacgcaagcacatggaatatcattcattgtctaaatcgaaagcggatcgtcacatggagccgtttatcattgacgtgatgccgacagaggacagcgactttgtgctttcttcgcatgaaggagaagagtttatcatggttatggaaggggttatggaaatcagctatggtaagaatacctatttgctggaagaaggtgatagtatttactatgactccatcgttcctcatcatgtacatgcttacgaagggcaggctgctaaaatattggctgtagtctacactccgatttaataaaatctgataccaaatattaagaataatcgcatgcaattatttgaacgtactcttgggcaatggctggaacattgggctgaagagactcccgataaggaatatatcgtttattccgaccgtaatcttcgttttacatggagccagcttaaccagcgtgtggatgatatggcgaaaggactgatcgctgttggtgtggaacgtggtactcatgtcggtatttgggcggcgaacgtgcccgattggctgacattgctgtatgcttgtgccaagattggtgcggtatacgtcacggtgaatacgaattataagcaggccgagctggagtatctctgccagaattccgatatgcatacactttgtatcgtcaatggtgaaaaggacagtgattttgtgcaaatgacgtatacgatgcttcctgaactgaaaacctgcgaacgcggtcatttgaagagtgaacgctttccgtatatgaagaatgtgatatacgtcggtcaggagaaacatcggggaatgtataatactgcggaaatcttgctgctggggaataatgtggaagatgaccgcctgactgaacttaaaagtaaagtggactgtcatgatgtggtaaatatgcaatatacatcaggaactaccggtttcccgaaaggagtgatgctgactcattataatattgccaacaacggttttctgaccggcgaacacatgaagtttacggcggatgacaaactctgttgttgtgtgccgctattccattgttttggagtggtgttggctacgatgaactgtctgactcatgggtgtacacaggtgatggtagagcggtttgatccgttggtcgtgttggcttccattcataaagaacgctgtacggctctttacggagtgcctacgatgtttattgccgagttgcatcatccgatgttcgacttgtttgatatgtcttgtctgcgtaccggtataatggcaggttcgttgtgtccggttgaactgatgaaacaggtagaagaaaagatgtacatgaaggttaccagtgtatacggactgactgaagccgctcccggtatgaccgctacccgcatcgatgattcgtttgatgtacgttgtaatacggtaggacgcgactttgaatttacagaagtcagagtgattgatcctgaaaccggcgaagaatgtccggtaggcgtacaaggcgaaatgtgcaatcgtggatataatacgatgaaagggtattataagaatccggaagctacggctgaagtgattgataaagataacttcctgcattcgggcgacttaggcattaaagatgaggacggaaattaccggatcacagggcgtatcaaggatatgattattcgtggtggtgaaaatatctatccacgtgaaatcgaagaattcctttataaacttgatggagtaaaggatgttcaggtagcagggattccctctaagaaatatggtgaagcggttggtgcttttatcatcttgcaggaaggggtggaaatgcatgagtcggacgttcgtgacttctgtaagaataagatttcccgttataagataccgaaatatgtcttttttgtgaaggagttcccgatgacaggcagtggtaaaattcagaaattcagactgaaagatcttggattgcagctttgtaaggagcagggaatagaaattatttaaataaagaattaaaaaagaagaatgaagaattagctgcgctgtatgctgcatagcaattcttcattcttctttttttagttcttcattcttaaatgaaatcgtctcccagttgcatctgggcatcattcacgtatttgcggatagaatgttcttcgtctttacggcagattagcaggacattgtccgattcggctatcagatagccttccaagccatcgatcacggcgagctttcctttggggagtacgatcatattatcttttccattatagatcaaagaatgactttttaaggtcacattgccttcccggtctctttctgataagtcgtagagtgatccccatgtgcccaggtcagaccagccaaaatcgcctaaagatacatatacattgtccgctttttccatgatgccgaagtcaatggatacattgggacatgcgggaaagttttcttcaatgaatgctttctctttatctgtagcatagatattttttcccggtgccagtttggatactaattcgggaagcaggatttctgcagctttaataatggtattgacgttccacataaataatccggagttccagtaaaattcaccgctttctacgaatactttggctaattccagttccggtttttcggtgaatgtctttactttgtagaagccatcaccggttggttcgtcaatttgtatatagccatatccggtctcaggacggttgggcttgatgcctagtgtcagtaacttttcagagtgagaaacgaattccagtcctttaatgattgcggcacggaattcttcttctttcaaaatcagatgatctgagggagcaacgacgatattcgcattcgggtttaaagcgcggatgtgataggcagcccatgcgatgcatggagcggtatttcttcttgcgggttccaataaaatctgtttctcatccaattcgggaagttgttccttcaccagatcggcgtacattgcattggtgacaataagaatattttcggttgggattaccttttgaaagcggtcgaaggtctgttgtaggagtgaacgaccggttccgaagaagtcaagaaattgtttgggcaatgttttgcggctaaacggccagaagcggctaccgataccaccacccataatcacgcaataattatccatgtttgtcatgatagtgactctatttttaaatgtttttgctaatgtacggtttattctctaaatacagaagcctttgggacatgttttattattttttgctccttttttttctcaaactattgtggaatcaaaatattgtcgtatctttgcaccgcaattgagaaatcaagcatgcccagatggcggaatcggtagacgcgctggtctcaaacaccagtggattcacttccatcccggttcgaccccgggtctgggtaccacgaaaagctaagaattgagcaatcaattacttagcttttttgttatagggtatttctttctaatgtgcactaccagaaggttttcgatattttctatagactgtgttatttgcagcaaaaatactaaaaaggtgcaattcatcgtaaaagtgaattgcaccttttcttatctctcagcatcatttatcccttgcctacctttatccaggttgctttcttccatagccattctaatggaccctggcgatgtgaacgaagccaccagttacaaaaaaagtattgtaaaaagaatacgcttacaccaataaggatacacgctgtaatgcctgtatgcagataaagtcctaatccccagttgtaaaacaagaaccctccgattaaagattgtgacaggtagttggtcaagctcatgcgtccataaggtgcaaatttatgaagaacattcttaagggttgtcaggtaataaaccagtatgatacctgcaaacatgattcctgtaaatacaatatttgacagtgacttgcatagaaggacagaaggtacaagtagtgcttcgcgacttataaagtcggggagtatatttatcaaaccataaatggggaaaaaggcggtaacggctatgatgaatactttaatccagatttttatattcttttctgaatagagaaacgcgttgctacgcccaattatcatacctaccataaacagaccggcggtttgagtaactcttccgtgtaatagcatccaacccatgttggcaacattacccgtccatatggcagttttgcacatttcgaggaaagaaccttctttctgagctgtattgactaactcccagtatggagcatcaagatcagcattaataacatagtcggggttgataagtgcataaattatttgtcccaattcaataggttgaagtagaagaatgactgctatgatcgtgactgttcgggtagagagtcggcagactgcgatcagtacataaccaagcaaggcgtagagtaccaatatttcacccggaaataaagccgaattaatacaagctataaaaagaagtaatactaatcgccaggcaaaccgcccacgaaaatctttccctttaagtttttgtgaattgtcttgaataaaaaaactaaatccaaaaagcaatgcaaagatgcagtatgccttaccggaaaaggtgaaaaatacactatcccaaattaccctatccgtaaatatcagaaagttacaggtctcttccggaaagctattgaggctaaaccgttcgataaaatggataagtgtaattcccattacagcgaacccacgtagcacatcagctatttctatacgattattatggggcaatgtgttagataaatgcatgctttttagaatttaaaatgttaacgtactttttcagatgcaaatttaacgcagcccttttatagttttggaaaaatactgttcaataaagaacaaaatatgacttttgtgtgctttgtatgattgataatgctgtttgtcttttatagttagcctgttgataacttcctgaatattaatgtaaataatgaaataaaatgctatgttggtcttattaaatagaaacaacttgtactgaatacatttctaatgaaaggtatacatgctattgttttgtttaatttgtgaggggttagtccaaatttaattttgtagtgtgggttaataaagtataactgttcattgacgatttgataatcagtctgttttactactcttcgaaacatttctattgtacatcgggtgtatttgatagttaataactctttgactgtgctttcttgttcgctgaataattccaatatccgtttatacaacatacgaggtagtaaatgtataaatggcatatgagagataatcttacttcttgcaatttgctgatgtccgccgaatggcatttgccaggcaggaaaagcaatgaagatcattccgttaggcgatagatatttttttaagttgcgcagaaattgctccttgttgtcgatatgttctattacatcatgtatgagaataagcgggaaatgtttctgtagatcttttaataagaagatatcagaagcgatgaaagttcctttttgccttttagtgatgaagaagttttgtgcctgttcaattcgggatgcggcaatatcaattccaatgacatcacaacctagctcggcaaagggaagcagattccctccttcgccacaccctacttccaatactttgtttggcagatttccagtatattctttaatataaggaatataataatttctcgtagtctgagcttgttcctcaaaataacgttcacggtttgtatgtcgtttctgcatctgatttgtctattgtttctaactgttctatagttatgataaactatcagccggaagactgcatggagaatgaattttttaccaagagaaacgaatgcctacaggaacagagaacgtaaccggatgttcttttcggattgtgcgcaatgaacttccatcgggaatatagtaattaatggttggctctatatagatgctggtgtgaggtgtaaagtggtattgtacacctgtactcgcattgattgaccattgcaaaggtacatctaatgactggtaacccaaattaatggggacactatctgtgacatgagaagtatgcagagttccttttatcgggatttccatttgtaaaccggctgttgagtaaaatgagaattgtttataattcccaaaacggtaggaaatacggagaggaatacctatgtaatggagcttctgggttttctgaatccgatattcctttcctgtggtgaactctgattttaaataaatatattgtaatccggtttctatactccagtggttattcaactttttgttcaatgctagtccgatagtgatggggctattatggtgttgatgttctataattcttccactgttgttcttggcaattgtcattagcgtaagcgagtctcctaaggttccttcctgattgcgggtgtttaaatagtcataatattcttcccaagtattgacttgctgggggagaccgctttccaaaccgtcagagtgtggtgttgtcatcaacttgtataggttttgtgccagttgtggtccgactgaccctgccaacatcattttccatttccctattttctttttggggagtgaagtgaattcttggcttgaatatgagaatgtaataattttctctgcatgctcccatgtaaaagatggtttggcaacaggctgtttctctactgagtcttttatttcagaagtggtagataatcctgttgcacttgtgtctaatgctaaccgggggaggtttgctaaagtagtattaaaaggggggtcttctttgtagtgagagatatgtccggaagaggtaatgctctcattttcttctttcttatctaatttcactttccgaatgacattgttagaccaatgattatctttagtctcttttcttttccagtatagatagtcgtgtatcgttgggaaaaaaaataaaatcactagtataagaatcagcctgtaatcagaaatcatctttttaagtaagacttttgccctgaataattgagaagaggaggagtggggagctatattcaacagtttacctatttccttgtgagataatccttccaatacagctaacttgaagattttgctgtatccttctggcaatttctctaccatttctgttattttatcataaggaatagaatcagatgatagcggattatcaataggctcctcgtcttcagggatatcagataagggaattgcagagtttgtactcttttggttgagataccttaatgaaatattcttcataattattcccatccagctttccagtttttcgggggtacgtaatgtctcaatcgaagtgaaaatgacaatgaatccgtcgtgtaggagatcttgtgcgatttgtttatcaggtatataatgaaggcatattctcatcatctttttcgaataggttttataaagtagacttaatgcctgctcattcccttttttacataaatctacaagttcttttatatccatgtgcgtgtattattttaatatgatgaatagaaaccgaaaagactgcatgctttttcggtttttaacatcttgttttttgcggatatgaagaaactttttgttgataaattgaacttgaatccataaaactttgacgaactttcaattattatgcaatctttgtgctctatacattttttatttcccgacaaactgctaactttatcatcattattataatgacatgtgaatagtcggttgtaccattatttaaatctcgtttatgggtaaatacaaatttatagaagaaagagtggaaacaatgtcttcgtcggagcttaagatattcttgaatatactgaagagcagatctaaggaattgatgtcaactctggagtcagtaaggggaataaaagatttggaggctgtttgtaaatcaactcagaaactaaacaatcgtgtttctgagtttgacggaggatcttttcttatattagtggttggacccgtgaaatcgggaaaatctactttagtaaatctcatagcacatgctcacgtcagccccactcatttcttggagtgtacggtgcgtccgtccattatttcaaaaggacaggaggaatccattacccgtattttttctgttgctgataaagctagaaaggtagaacagtttgattcggtcattgatagcctgcgcggatttgaaaaactggaaaacatttccgagataagcattgaaaagaaagaattgaatgatgctaatctggaggagtgtgtttcgttagctttggaagaaagcgtgataaatacagatcatacgctggtgacatccataacaacttccggtggggagcttttgaaagataatatatttctggtggatatgcccgggctggatggcgggtatgtgaatttggataatcctatttatgaaacgatctctcaaagggcagatttcgtgatatttgtgcaaagttcaaattctgctatatcgaaggtttccaatcgttttctgaagttgctgcaggagaataatccgaaagttccggtttgtcttctacataatgtgtttgaagcggcttactggcattcggaagaggagaagcaggctgtaattaaggcacaggtagaatttgccgagaatgaaatgggcagacgtaacttccagttgaaggagaatatatatagtttgaacttgggaaaagtggcggatgctgccagctatgagggaatggaggatcttcaggaagaagctgcgaaatttcagagatttgagaaggatttgtatggcaaggtgatctccaatagtactgatatacgtctgagaagcgtaatcggaagaacgctgaatcagttggaaaaactggataatttagtcggagaatcaattggccaacaggaagcaatcgatatagaatatcaggctgcggcaacttcgtttgacgagttactccgtcaggcgagtgaacttagttacgatgggagcgattttagaaaaatggtgcaagtctatatggatgatgatttgaaagagtttactgaaatcgttagggagtattatgattccggatgcaattccgcatttgccggtggagcgaaggggaaagatgcgacacgcagccttgttacaaagtttatgactgattcgtcagcggcgataaaaagtaagttccttgattcccatgaacatagcctggcccggcagtatttgcggaaactctctaacttgaaagatgatgtggcttttatagagaagatgaatacttttctgaagcagaaaggttgtgcaccttttgactcagtgccgcaagtgacggattttccggtggtcgattttgatttgcagggagcttttgatgtgaagaatattaataatccgactgttccgcatatcggaatacccaatccgttcgggacttattcgacaatggaaattcagagttttctgagaaaagcgatggaatgtatcaccggaatcgatcatacgcataccgggaaaacgatcaaaggatatcttcagctgactgtcgggaagagtatatataaggcggctaatgacctttatgatcagtatgtgcctgtacgcaaacaaagtatcattgattttttggaacaacaaaaaacaatgtatctgaatgcgctggtgtctgataaagaagaatttgacaggaaggatgcgttgcttcggtcaataaatgcacaagttcagagttttaaggattcaataagataagaataagccaatgaaacgaaatttattaattatcacactcctgtttttgggctcttttgtgattttattgttgggtaacatcattattattggtgagaaaatagcctccttatcgcaggttgcgtgggcagagtatgctttttacaccttgattctggttgtattttatgccgtcgttatacgtccggtcgttcgggtgcatcgtgctccgcagtttccggctttgtctattgatggggagtggaatactgcacaacttgttgcgtttggacataaactggcggataactgcaattatatacctaaagataagtcctgtcccgagttaagaaaactgcatcagcagagattgcgtgaagatttggaacgttatgcaacgagtaaggaagaactggtgcaaatcataagcgaagagctgaaattgcgcattgaagggggagaactgaaagaaacgtcaggtccgcgtacagaggatatgcattcggtccgtatcatcggcatcaatcgtcgcgttatcgaatgggctaaatctgtttttatgattaccgccatttcgcagaacggaaagctggacacggtgtccgtgctttatatgaattataaaatgatagaggatgtgattgttgcttccggcttccgacctacaaggcaacagttgttccggcagtatgtcaatattctggttacttcattaatgactttcgtcgcatcggaggtctttagagatatgggttcggttgcccccttcggctcattggcagaccagtcttcggatgcagcgtccgatatcgacgtttccgatgctgccgccgatggtgccgatgtggatgtggatttggacgacataggagatacagtttcaggagataccggctttttgagcattctgtctaacgtgaaaattccgggagtagtcatcggttcgatatgcgatggcatcgtgaattcgctgatgactttacgtatcggttacgtgacgcgtaactatctgattgatggaatgaattcattaaatggaatcaaagctaaaagaaaagcaaagcgtgcagctgtgaaagaggctctgaagtctttgcccaaagttgtcgtggtaggtacttctttcgtgggaaagggagctatgaacattattctgaatattattggcgggaagaaagtgaaggaaactaatgaaaattgattttctctttcaacctgtcaccgcctcctgaaactctttattcatcagtaatgtatgctggtgataggtcgcagaccatctgtcactgatctatcacctgtcaccgtcggcacacacatatatttattctctttttgctttaattcgtaccacccgatacacattacctcgtttggtatgcacagaaggcacccgattcttttgtaatattcttccgaactgaataatattgcaatcggatacgcgaatcttgctatcatgttgcacctgctccagaatttcgatggcaaggaattgttcgcattcttctccttctgtagctgcccggaaatactcatggaataattgttctgcaattggcatcacctggaactcctggttactttcattcatcaccttctcatcttccggatcaaaccaataccgttcccccttgtatagatcatgcatcgcctgtgcatagagctgttcgtaatcaattggggaacaatcgattggtccggtcacatcgacaacaatataacggcggctaccggaagtgtccgtcagcaggtctttgtgattgctcgtcccaatgaaggaggcgtaacgacgcatctcttgcgtagccgtaccgtgtggacggcggacattgacaatcggtttctgaaaaatatgtttcaaaaaagcctgttgattcactctgttctggtcaaattcgtccatattgatcagtgcgaaccgattgagggatatctcggcatcccgtttgttactgaaatcaatgcggtccgtgtaatatgcctgtaattcgggaggaagtaaactccggcaaaaagtagactttcggtaagcctgcggacctacgagcaatggtacagtgcaattcgcatatttccggtctgtctgccgccaatgtgccaccatattcagaaaccagcgatagaacaagtccgcccaatgtcggttgttgcagggaacccgggctgctagttcgcgaatccggtcgtgcccgtcccaacgtacatccagtccgaagagaaaatcttcgatcggattgaaaatcggaatccggtcggagtccagataacggaccacatccctgtcccaaagactgagtccttccagccttgcgttcatggcgatactgtttcgaacacggctgctcagggggcggaagtagaaacaaaacgtattccgttcccgatattccgttactgtcgtcattgtattgtaacggaattcgtatctgcgttgcataaattcttccgttcgcagctccagttcctgttctgccgacaggggagattttttgccgaagcctttggcgatggtgtatacactctgtactgtctggcggatcagaaactcttttttctgcctatataaatgagcgattgcacaacgggcggtttcttcttccggtatgcctgcctggaagcaattttcggctaactgaaccaataaaggcttcaagtcttcatcggatcggggatatatccccggctgaagttcgcttaaagattggcatgccttgtttaaagccacttcgaagagcgcagacaatgtttcaagactgtcatatcccgggatcaatcgcttgaatggcgatgtttccgcctgtacggcttcttggtaggtcgtttccgagggcatttccattggctggcgcatatacataatggtggagtcgggattgtaataaagttccgggtcgtatgtttgccggcaaaattgctctaatgccggatttttcaattcaatggaataggagagtataggctggtataagctgacagcttttctataggcatgcgcttgaaagatttccgcttcttcccggtttttgggaagtgatttgtccggtcgtgtgaaccgtacccatatttttacggaatgtccgctggaacccatgaaagcaagataagtctgcgaaagctcttccgcttcctgcttcacccggttcacttccatcaagtttgccagatgattgacttctatttgtatgattccgttgtatgcggtcatctgtatgccgttggccgttttgcgaaaagctgcagccgggatgacttttgtcaatttcttggcgtcgtccagcttggcgtccggtgatgcgtaacgtatgcttgtccgtagattgctgatcggttgggctttcgtttcatgcttcatcgcttctatttgtaggtttatgtccaacgttcgcatggttggtgtccctccgttgtcccgcatcaaagtaagtttcataatgaatgtgtctgtaaaatgatctaattattgaatttgttattgttaatgtctttcttccggaaggcatgtaaaggtacgctttattattcggcttcacaaatgtttgtgttgtacttttcttaaagttttttatatatcggttggttcgttgtctattataggtttacgtgttgtctattaatagaaaagttcctttcttcctattgcaaagttcctttcctctaatagtaaagttgtttttgtccgcttataaactacaaatgcaagttttaattatagaaatgaaatctttgtttttataaatgaagcttgcatttataaaaacagagattgcgtttatagttttcaataggtggaaaataacttatctattagagaaaagtaagtttagttctaatagagtagaacaatatattcctcttataggaagttaatgttattatatctatctgattatctttgatatacttgtcaagtccttttaatagattatcattcattaccacatcataatgaatttcaagcccgggatattgtttttggaaatagtctttgatacctgcaagtttaatttcattccaagtatctttggattcagccagatgtattaatgagactgaaaaatggaaagatttccatgtgttgaaaaatgcttcaaaagcaatcaagtctctctgatcaaaattggttaagaaagcaatacgttttacttcattgaattctttgaatggagtattttccggaatagccaatactgctgtgcggcttcgatcaataatttcagctgttacactgccaattaagtcaatgtctttctggctttttccacgcgttcccataatgataaccttaggacgttgctccttggcatatcttaagatttcttcctccggaattccttctcgtaaaatgcaactatatttgatatccggaaattctccagatgcaactttttccttaatcttatcagatagtgcgttgagatctgaatggacctgctggatgattgttttaacagattcttcatctccgatctgataattgaatacatcgccatatggtaatgacgaagcgtatatcggtgtaaagtaaacatgtaatagaatcacttcagaattctcagttttggccaaattaaagccaaattcacacgctttcatcgaataattggagaagtcgacaggtattaaaattttgttcgatttactatctaccttaggtgtcttctctcccactatactttcagataaccaagtagaactttccgttatttttaatgcacgtggtagatcactttctttaattcgcagacgtactcctgaagatacaacaggttgtatttgatttacgttatgaatgtatgtttctattccttcattttcgaggacattctttagaatctgagcttttgtataagtcagaatagctaaggttactaatttatcttccataataatctgtttttgaaggtaaacaaataagaaatcccaattgtttgggcaattgggattcttgttttatattttaaatttgcataggttcggtagcttgttctttttgcatactcatgtttatttcatctaaaatttttagagcccggtcgagaacagttgtgtcatctagcattacaagcccgccatccggaccaggctcaagatgtattccgacactttttccttccttgaaattatggcctccgaagaagttgcgcactgtatctacgtgcaaaccaagttcgtctgctattctatgcatgctaccgctaggcaatgaatctttaatcttgcgaagttcattaaatgttattgttctcatgtctcataaatttaatggttaatactatattgtatttaattttttatcacgctataaacttaagcaaaaaaaaagataaaacaaattatttgcttatcttttttcctaaattcctaaattctgtttacgaattttatatcacttcaatagcggaagccggtacccatcctactttgccgtcttccaagcgaatttctttccattctttcattgagttatctttgatactgaccttacgtccctcatgaaggatgaacaaacttgttccactttcactcggagtgctgcgaactgttacactaggattcatgacgatcgcttcgcttctatttactaaacgttctttttgctctgaagcaaaaagattagagcatatcacaacgattaagaaaacgatacctgatataaatcctgttttttttagtataatctgcttggagaaaataaagaagtaaaaagcgatgataaatagaataaaggagacaattccccatgtagcccatgcgtctacactcatactgtttatcaaggctttggtccatgatacaaagaaaacttccggaacaggttctactttatctattgttttagcgcgtgccacttccagattggcacggatgtcgctgtttcctggtttcataagcaaagcacgttcgtagttgagtacggcttttgcaatttctccagctttgtagtaactgtttcctaaattatagtacacatccgcagattccccattttttaataaggattcatatatttggatagcagttgcataatcatcttttatatatgcggaatctccttcggcttttgttacatcttccaatttcgtatcagaaaatgtatgtgaacccgcatggatagaatcagcttcagttatttgtatagaatcaatgctctgagttccctgtccgaagcaagtaactgacattgataataatataaaaaacaatatttttttcatgacacaatctcttctgggttaatgttttattgaattttccattctgcttatcacttctattgaagaagagtagactttatccattgcctgattttcatcacctggagcgaaacgagcaaattcacaatcattcaatgcattcaggaattctttaattagttcttcacttactccatggtttctcagcttctcttcaatattgtctttcgacaaacgggaaaccggaatactgagtttgtcgctgatatatccccacaatgctttcagtacttcatcatagaaggcatctttcttgttttcagagagcaacttaccggctagtttcatgcgcttggttgctaccttattagctttctttgttttcatcttagcaacattggcatttgtagcggcttgtttgcggtagatgataaagaagatgatgaaggctaaagcaggaatgatatagaatagccaataggtcattgagccatagaagaaactacccttaggttggagagtaacttcattttgcttaatgtaacggatatcttcacccaatactttcaagtcttctttattggtgaaattggcaatcacctgatcagcatttcctgcacctttctcaacattgattacgtagtcttccgttttcaacgttttgtaagattttgaacggatatcgaaatagctgaaagatgcccccgggattttataattgcctgcatgtcttggaatagccagatattcaatgactttgtttcctgtaagaccttcctgagttaatctgacttggttgtccaccttcggatcatatacttcaaagtcatccgggaacttaatttctggattagaaatcagctttaggtttccggtgccggagattaccaacttaatggtgatagcatcattagttttcagctccttgctattaatggaagaagaaatgttgaactctcccactccacctgaaaagtttgcaggtttaccagcaggaagcggattgacattaattgctattttaggagtaacgatagatttcggtactttaactacattgcttccaccattgaaaaatgcatcaaaaggatcgtcagattgtacagctttacctaccgtcatctggaactgtgccggttctataaataacttacctggttgctggggaaataatacgaattggcgatagattgtcgtattatagttacgtcctttataatgctcctgtgtccatcttgcatttgcattcatttcaatttcttgagaatgaaatcctttaaagtcaggcagtttggcattattcaattgcaagtcatgttctctggtgtatattttataggttaagacaaatgcttcctgctcgtatacattcgttttactggcagttgctgtgataaacaaatcctggttagatacacttgtaccggatgaagagcgtgcagatgagctaccgtcattttgtcctccattactagcttggtcttgtggcaaaaccttcacctttacggagtttgaaaccatctggttgccatcagctacaatagaagctccggggattgtatattcaccggcagtatttgccatcaatatataagtgaatgtaatactacttgtagaggtgacattaccattcattatctgtgtactactttgctgagaacggcttggccccatcaggacgtcgaatcctttgatagccggtgcctgaaagtctttaactttttgtgtggttactgtataagatagcctgaattgatcccctacaaccactacatcgggagcggaagcagtgaatgacaccttgtcggcaagcgcttgggtgctatatgctatcaatgccatcaatataacaatcagttttttcattgcttatgaaatttatatcatcaactttttattattaccaatctttttccagacgaccgccctgaataactttctgttgtttcttcactttgtcctgtacgtctttctcatcctgaatcacagagttaagtaactgttcagcattttcctttgacatctgattatcttgtttttcaggcttcggcggttgttgctgatccttttggtcgtctttcttctgatcgttctgtttatctttgttttgatcctgtttctggtcttgcttctgctgctgatctttattctggtcttgattttgatcttgatcctgctgattctgttggtctttcaacatcttttgagcgagtgccaggttataccgtgtttcatgatctgcaggattgttgcgcagcgacattttgtaggcatccactgcttttgcataatctttaccagcttgaaaaagcactcccatattatggtaaatgtgtgccaatttcattttatccttttctattttgctggcagaatcatattgctccatggcttcctgaaacttttgttgttgtgagagcgtatttcccaaattgtacatggatacagcagatttaggattaacttccaaagccttgcgataattaacttctgcatctacgaatacactatcattgaacagacgatttcctttgcggatatagtcacgctctgctttctgtgccgaaacgccggcagccgataacagaaaagcagcaaacaggatatatttcatttttaacatacgcatagcttacttcttattagagaacagatgaacgtttttgaataatggattcttacgatccaaaattaacatctcagctagtaacaatagtaaaatgatccatgcaatagcctgaaactgttcgttgaaatccgtatatattttcgattccacatcagacttagccatcttacttatttcctgactgatagccttttgagcagaattagaattatctacccgtacatagataccctttccgtctttggctatttcttgacacatgccctcattcagacgggttacaattacattaccttcgcggtcacggcgataatcattggtaccttctacaggaataggagcaccttcgggcatacctactcccagcacacttacctgaatccctttttcggcagcagctttagcagcttctacagcgccaccttcatgattctcaccatccgtgatgacaatgatagcacgtcccactccttcttgcggagtaaaactgcgggttgccaggttgattgcctctccgattgctgtaccctgcttggaaatcagcgatgggctgatagattccaaaaacattttggcggaaatataatcgctcgtgatcggtagctgggtaaaagcatctccggcaaatacgatcataccgactttgtcgttatctaattcatctaccaatctggatattaatctcttggctttttccaaacggctgggctgcacatcctgcgccagcatagaattagatatatccagagctataatcacttccacccctttacgtttcaccgtttcctgcttggaaccaaattgcggacgagccagcaatactgagaataagccgatagcggcaaagatgagccaaaatttcacatccggtcgatatttagatacatccggcattaattgcgctaacaattccggatctccaaaacgtcggatatttctccgtctcctgtaattggaatacaagtagaaagctgctaaaaacggtaatagcagcaataaatataaatatgcaggttcttcaaatcgaaacatcttcttcctattttacgttacaaatcacgattgacgaaacattcctacggaattttcttgagtattgaattacgcaataaaacttccagtagtacacaaaggaaagcagccagtgcaaaccagcgatagtcttcttcccgtttgctatactcttttacgttcaactttgttttctccagcttgtcaatttcttcatatacctctttcagtttcgagttgctcgtagctctgaaatagttaccatcggtagtaccggcaatctgagtcagtgttttctcatcgatttccaccggcatattgatatactgtactgtattaccgaccggataaggatatggagccattccattcgtacccactccgatggtatacacacggataccgaaacttttggcaatctcagcggctgtcaatggcgaaatatctcctttattattggtaccatccgtcaataagatgataacttttgatttcgctttactgtctttcaggcgggttacagcatttgcaactcccataccaacagctgtaccatcttcaataaggccacatttgatattatgaatcatatccagcaatacagcatggtccacagtcagcgggcattgagtgaatgtttctccggcaaacagagtgataccaatattatcattcgggcgtccgttaataaattcggctgctacatctttagcagcttccagtctgtttggcttcaagtcttccgccagcatactggtagacacgtcgatagccagcataatatcaattccctctatttcgctgttttgccacttattagtgctttgcggacgcgctaataccacaataatcaaagccaatgcaatgacgcgcagtataaatggagcatgtagcaaataattcttataacttttaggagtatgcgcatatacccgtgcatccgaaatctgaagggtagcttcagttttctttcgcttcaagatataccatacaatataaggtataagcaataatagcaaaaacagatattcaatattggcaaaaaacattttattttcgatttaacagtttactatttagtattcacaccacattatgcaaagagatcataaagctgcatacctatatatacaaaagtacctattaatgctgctgacaagaatacaataccgcagattaataatattttagtacgcagagaacgtttctcgataattgtgatttccgttggttgcggtttctgattctcctcttccggttgctttgtttcgttgataaagtcgattgcattaatcaaattcgcatcattttcattcatttgcggatcatgcttggcaaattttactaaatcagctgtctggaagagttccttcaaatctgatattgcctctttatcattcatttccaataacttatcgatgatttcagaagaagtcatctctagtgcattgaatccgaaacgatctttaatataagtacgaagagtatctgtcaattccgtataatatgccttcggctgtcctttctgccatactttctcattcttgatacgttcgatttccttcatagcagcctgatgtggtggcaacttaggttctacttttatcttacggataatcggtttgttatcacgtatacgaatgatcagatagatcaataagccgagtaaaggcaatgcaagaaatgagcaaccgatcagcccataccagtcttcccatgcgaaaggcgctttcatcaccgttttctgtccgaagaactggtctggatgcaatgtgtcaactggcatagaatatactttcaatgccagagctttcgatctatattctttgccatccacagtgacaggcatcggcggaagataatagagagctgagtcaaacgaggtaacaatgtattcctgagtaatcagcattcgttggcgatcattcagaaattgtgtatccggtttggcggtttctataatttctacccctcgcaccagtgtatcggtataagcaggaaaaacagcacgttgtttggcgtccatcgctacttgtaattgtactttcgcctgttcgccaattaatatctgcaacgaatctatcttagcttccactgtaacagactgtgccacagttctacctatagaaagcagacataacaatgctatcagaataatatttctattcatctttgattccattaatttcgtttggcaaataaattcagcaatgcctttacgtaatcctggtcggttctcacagatacggagtcaacattacttttggtaaatgtgtcgttcagttcggtctgtttgtttatccaccagtcacggtgtgcccggcgtacagctttggaagaagtatcgatccattgttcatggccggtttccgcatcttttattcgcatcagtcccaccggaggaagatcactcactctcctatcgtaaacctgcaatgccactacgtcatgctttcggttggcaatagtcagagcgtttttaaagttatcctgatcgatgaagtcagatagaataaacgctgtacaacgtcttttcattacattagtcagatactccaatgcgagacgaatattggtacgacggctttccggttggaagtcaatcagttcgcggataatatatagaatgtgtttacgtccctttttaggaggaataaacttttctatccggtctgaaaagaagatcacaccaattttatcgttgttttgtatagcggaaaatgcaagagtagctgcaatttccgttaccatatccttcttcagttgtttaaccgtaccaaattccaaacttccggaaacatcgaccatcaacatcactgtcagttcgcgctcttcttcaaacaccttcacataaggtttgttgaatcgtgccgtcacattccagtcgatgtcgcgtatatcgtcgccgaactgatactcacggacttcagagaacgacatacctctacctttgaaagccgaatggtattggcctgcaaagatattgttagacagtcctcgtgtcttgatttcaatctgacgaactttttttaatatttcacttgtttccatttatacagtagttaaagtagtaagtagtcaggtagttaagtaaaatacacttgactaccttttactgcattgtaatattacggcagattagggcacttcaaccttgttcagaatcttgctgatgatttcgtccgaagtcatgttgttggcttccgcctcgtatgtcagtccaatacggtgacgaagaacatcatgcgcaacagcacgtacatcttccgggattacatagccgcggcgtttgatgaaagcgtatgtgcgggcagctagtgccagattgatagaagcacgcggtgagccaccaaatccgatcatgtctttcagttctttgagatcgtatttctcggggaaacgagtagcaaatacaatatctacaatataacgttctattttctcatccagataaacctggcgaaccaccttgcgggcttcgataatttcttctgctttcaggataggtttcacattgaacttctcaccgttgatattctgacggataatcagtttttcttcttccagcttcggatagtcaatcactactttcagcatgaaacggtctacctgtgcttcaggaagcgggtaagtaccttcttgttcaatcgggttctgagtggccaatactaagaaaggttccggcaacatgaatgtttccttaccaatagtaacctgacgttcttgcatggcttccagcaaggcactctgtactttggccggagcacggtttatttcatccgctaatacgaagttggcaaagataggtcctctttgtactttgaaagattcatctttctgactgtaaaccattgtaccaataacatcggccggcaataagtcgggagtgaactgaatacggctatatttcgcgtcgatcagggaagcgagtgttttgatagccaaagtttttgccagaccgggtacaccttctaaaagaacatgtccgtcggaaagcaatccgataagcagtgattcaaccaaatgtttctgaccaacaatgatttggtccatacctgtcgtaagattggtaacgaaagcactttgtctttcaatccgctcattcagttcgcggatatcaattgattcagccataaatacttaatattttattatttaattctcattaattaaggtgtaagacttaccagtgtgtaaggcttctaaattcgctcccaaaagtacgccatataattaacgattgcaactaatttttattaaaaaacaatgcgaaatctttagattaaggtactttcatacgcttttgtacttacgtaacatttcacccggctatacattgctgtatgagccgggtgaataggtgttttttgtttttattcttttgtaagttccggtatctcgattgtcgtaccgtatggtacgttatcggggttcttgattactttcgggttatgttttacgatatatggccacatggcttttgtaccgtaaaagcgtaatgaaactttcgttaaagtctctccttctttaattgtgtattttgttttggtaccggttatcttgtaggatgcggaatccgaatatgccgaagctgttggttgttgttgggcaggtttactttctgctttgacaggttccgctgtcggttccttcttgacaacaggttgcggttggactgcttccaccacagtatccttgtgtgcaattgtatctgaaagctgtgcttccggctgcacaggttgagtaacttccggtatatcaaccacattcttatcagacgaagatgagaacaaatccggataataaataaacaggatagctcctccgcacagtagtaagactataataatagttgctattaaataaggaatagctgatttttcctttttatcactgtctttatcagtataggtggctttcggttgttctatttccggctgttcttggagagtgacaggctccatatttgctttatgaagctcttgggctataatttgctctgcagtaacttccgctttttctgtaataaccgttttctcttcctcctcttctgttgtttcagtctctggtttctgctcttctataattgtttcttccgattgttccttagcaggttcctctgtcaccggactgaagtcaggttccaaaacagtttccgaagattcctctacaggctcttctcctggggcttcctcagatacagattccggtttcggttcaattttcacttccggcaattcttcagcttctggttcttctgttgcaattagttccggttctgtttcaggttgaccggtttcattcgcgtcagtttcaggaacttcagccacagctactgcttcagcagtcggctgctcttcgattacaggttcttccagttgtatttcttcctgaatatctccaccggcattttcatttcctgctatttcagagtcgatcatttcagtctctgtatcagaaaccgcaccttcctcctcatcggattcttccataggggtatcttccaataccgtaccttcatttaatactaccgtttcaaaatgtgcaaaaggcttatttattgtatctctcagattggtgtccggagtaaacgatactttggtatgaccttttatctggaaacgttcccctgtgttgacattaacgctttcccgactatctacatccacaagtttgaaagtccccaatcctttgattttcacagtcttctcattctccagggcttgttctatcaagagaaaaaactctttgacgaatgcttcggcatccttcttggtcatgctatgtttagccgccaataagtcgataaggtcttgaattgtcagtctttcattcataatgggaaatatatattatttaaacttgtctttcagtgtattgctgggtctgtacgtcaataccaatttaggaggaaccagcatacgttgcttcgtggacggattgatcgaaatgcgctccgcttttttcttcacttcaaaagaaccaaagccctgtattgcaatcgcattcccgtcttccagttcctgtgtcatgtcagacaataaagaacttatcagttcagaagtgtctttgatagtataccccagtctgtctgccagttccgatgtaaattccttattattcatacttgtttaatatctttgcatataaatcaaaatcgtccgcatcggttacttctacctgatagaattgtccgacttcaagttcttctctggaaacactgatcaatacttctgggtctacctccggtgaatcaaattccgtacgtccgatataataatctccctcgatccggtcgatgatgactttcatctgctgaccaatttttgcagcgctcaattctgctgaaataccttgctggatatccattagctcgtccagtcgggcttgtttaacctcctgtggtatagagtcttcatattgctgggcagcataagtaccctcttcttcagaataagcgaaagcccccatcctgtcgaaacgcgccttgcgtacaaattctttcagctcttcaaagtcttcttccgtttctccgggatgtcctaccatcagcgtagtgcgcagatggatacccggtacttctttacggaactgttcgatcagcttgtacgtatcttctttgcttacttgccgacgcatcagtttcaacatgttgtcactgatatgctgcaaggctatatccatatatttgcagacattatcgcgttcccgcatcacccgaaataaatccgttggaaaatgtgccggatacgcataatgcagacgaatccactctacacccggaatttccgagatacgttcgatcaattcgggcagcatttgctttttatacagatcgactccgtaatacgtcaattcctgagcgatcacctgaaactcctttaccccttgcgataccagataccggacttcatccagtatttcttccatcgacttggatatatggcgtcctgtaataatgggaatagcacaataagagcacttgcggtcacatccttctgaaatcttcagataagcataatgcttgggagtggtcaaagtacgctcaatatacaattcctcatggtacgtttttcccaagtcctgcaagagttctttccagttgaatttgccgtagaacttgtctacctgtggtatttcaatggccagttcttgtaaataacgctcggaaagacagcccattacaaacagtttcttcaagtcgccttcttcttttctttctgcaaattccagaatcatattgatagactcttctttcgcgtcaccgatgaaaccgcaggtgttgattaccgctatctccccttccggattttctgtatcatgagttacgctgtatcctgcttcttccagctgacgcatcaactgctccgagtctactaaatttttagaacaacctaaagtaataatatctattctctttcttttcatgcattctctccaaacagggaatcaacaaattcatttttgcggaagacttgcaaatcttccatgccttcacccaatccaatgtattttacaggaatcttgaactggtcggagatgccgatcactactccgcctttggcggttccgtccaacttggtgatagccattgcagtcacctccgtagccaatgtaaattgcttggcttgctcgaaagcattctgtccggtagaaccatccaataccagcaggacttcatccggtgcattgggtactaccttcttcatgacgttctttatcttggtaagctcattcatcaagcctactttattgtgtaagcggccggccgtatcgataatcactacatccgcattgttggcaacagcagaactcagtgtatcgaaagcgacagatgcagggtccgcacccattttctgttttacaacaggcacacctacgcgttcaccccagatcatcaactgctctacggcagctgcacggaatgtatcggcggcacccaaataaacagatttgcccgctttcttgaattgataagctaatttcccgattgttgttgttttacctaccccgtttactcccactaccatcattacataaggctttttcttgataggtacatcaaagtctgctacgtcatccgaattattctcggtcaaaagggcagcaatttcatcacgcagtatgtgattcaactcttgagtattcacatatttgtctgcagcggcccgtttttcgatacgtttgataatattcaaagttgtctctacccccacgtcagatgtgatcaaaacttcttccagattatccaatacttcgtcgtctactttcgacttaccagccacggcacgagcgattttactgaatacgctctctttggttttagataatcctttatctaaagtttccttcttttcctttgaaaaaaaactaaaaaatcccatatctacagttatttgtataatacattatgctacaaagatataacaaaggattggaaaagtaaaaaaagaagcaataaaaaatcccctcactgcttatatatataatacaaagcattgtttttatggcacgccatttgtagatataagaaataaagcaaatatgcaatacaaacttgattaaatacgtatatttgccagtaaataaccccttagaagaaaaggaaaaagtatgaataatcaattctcacaaagagtttccgacattatcgtctatagcaaggaagaagctaaccggttgaggagtaggcatatcggacctgagcacctacttctgggaatgcttcgtgacggtgaaggaaaagctatcgagatattgtcaaaactcaacaccaatttagctgcagtaaagcagcagattgaagctcggctgaagacagaagctgatgatatgctattgcctgatgcagagataccgttgtctaatgacgcggcaaaaatattaaaaatgtgtattttagaagcacgtggaatgaaaagtaatatagctgatacagagcatgttttgttagcgatcctaagagaaagaaacaatatggctgcttccgtgctcgaagctaatgacgttaattacgtgaaagtgttggaacaagccacattgcaaccggatgtaaattccggtatgggatttccggaagacgatgatgatgaagaaatgtcttctccccgatctggtggaagcggttctgaagaacgccagcaacaggcgcaaacagcttcaaaaaaaccggccaatgacacgcctgtacttgacaatttcggtacagatatgacaaaagcggcagaagaaggacgtttggaccctgtggtaggcagagaaaaggaaattgaacgcttggctcaaattctgagtcgccgcaaaaagaacaatccgattctgatcggtgaacctggtgtaggaaaatcagcaatcgttgaaggactagctttgagaattattcaaaagaaagtctcacgcatcttgtttgataagcgagtagtagctcttgacatgaccgcagttgtggcaggaacaaaataccgtggtcagtttgaagagcgtattcgttccattctcaacgagttacaaaggaatccgaatgtgatcctgttcattgatgagatccatacaattgtaggtgcaggttctgcagccggttcaatggatgcagccaatatgctgaaacctgcattggcacgcggcgaaatacaatgtattggtgctactacccttgatgaataccgtaagaatatagaaaaagacggtgctttggaacgtcgtttccaaaaagttatggtggaacccactactgctgccgaaactcttcagattctgcgtaacatcaaggataaatatgaagatcatcataacgtgaactatacagatgaagcattggaagcttgtgtcaagttgacagaccgttatattacggaccgtaacttccctgataaagctattgacgctttggatgaagcaggatcacgtgtacatctgaccaacgtcaatgtgcccaaggaaatcgaagagcaggaaaaactcatcgaagaagctaaaagcaagaaaaatgaagctgtgaaatcgcaaaattttgaactcgctgccagtttccgagataaggagaaagagcttacgcttcagttggacgaaatgaaacgggaatgggaaaacagcctgaaagagaacagacagactgttgatgcagaggaaattgccaatgttatttctatgatgtccggcattccggtacagcgtatggcgcaagccgaaggaattaagctagccggcatgaaggaggatctgcaatcgaaagtgatcgcacaagatccggctatagagaaactggttaaagctattttaagaagccgtgtgggattgaaggatcccaataagcccattggaacctttatgttcttaggcccgactggtgtaggtaaaacccatttagccaaagaattggcaaaatatatgttcggctcttccgatgcactgattcgtatagacatgagcgaatttatggaaaaattcactgtctcacgtctggtcggagctcctccgggatatgtaggatatgaagaaggcggacaattaactgaaaaagtacgtcgcaaaccttattctatcgtcttgcttgatgagatcgaaaaagcacatccggatgtgttcaatctccttcttcaagtgatggacgaaggccgtctaactgacagttatggcagaatggttgattttaaaaatacagttattatcatgacttccaatattggcacccgccagttaaaggagtttggacgtggtgtaggatttgctacacaaagccgtctggatgataaagagttctcgcgaagtgttatacaaaaagcattaaataaatcattcgcgccagaatttatcaatcgtgtcgatgaaatcataacatttgaccaactctctttggaagctatcacgaaaatcattgatattgagctaaaaggactatatgatcgtattgaatctattggatataagctagttattgatgatgaagcaaaaagatttgtggccgaaaaaggatacgacgtgcaattcggagcccgccctttaaaacgagctattcaaactcatctagaggatggactgtcagaactcattataacttcttctctgaaagaaaaagatgtcattcaagtctctctgaataaagagaaaggtgaattggagatgaaagttattgcatcttgaaagaagattgcttaaataagataagttataaaatatgccagaatgtcagaccttagggtctggcattttttttgtctctatctgaacaaatatcaattaaaaacattctaataaataaaccaaaaaaatatacgttattatgcaaaaaggtaatattggggttacaacagagaacattttccctatcatcaaaaagttcttgtacagtgaccatgaaatttttcttcgcgaattagtgtctaacgcagtagatgccactcagaaactgaatacccttgcttccattggagagtttaaaggtgaactgggcgatctgacaattcacgttgaattaggtaaagacactattactatctccgaccgtggtattggtctgactgcagaagaaatagaaaagtacattaatcagattgcattttcaggagcaaatgattttctggaaaaatacaaagatgatgcaaatgcaatcatcggacatttcggtttaggcttctattctgcctttatggttgcaaaaaaggttgaaattatcaccaaatcctacagagacgaagcacaagctataaaatggacttgtgatggtagccctgaattcactattgaagaagtagataaggcagatcgtggttcagatatcatcttatatatcgatgacgattgcaaagaattcctcgaagaagcacgtgtttctgagcttctgaagaaatattgcagcttccttcctgtccccattgcattcggaaaaaagaaagaatggaaagatggcaaacagatagaaaccactgaagacaatattattaacgataccactccattgtggactcgtaagccgagcgaactgtcggacgaggattataagtcgttctataccaagttgtacccgatgtcagacgagccattattttggattcatctgaatgtagattacccgttccatctgaccggtatcctctatttcccgaaagtaaagagcaatattgagctgaataaaaataagattcaattatattgcaaccaagtatatgtaacggattctgtagaaggaattgtaccggacttcttgactttattacatggagttattgattctccggatattccattgaatgtatcccgttcttatttgcaaagcgactcgaatgtgaagaagatttctacctatatcacaaagaaagtttccgatcgcctgcaatcgattttcaagaacgaccgcaaacagtttgaagagaagtggaatgatttgaaaatatttatcaattacggcatgcttactcaagaggatttctatgagaaagcgcaaaaattcgcccttttcaccgatacagataacaaacattatacatttgaagagtatcagacccttattaaagataatcagacagacaaagatggaaatctgatctatttgtatgctaataataaggatgaacaattcagttatatcgaggctgccaccaacaaggggtacaatgttctgcttatggatggtcaattagatgtagctatggtaagtatgttggaacagaagtttgagaaatctcgcttcacccgtgtagacagcgatgttatcgacaaccttatcatcaaagaagacaagaaaaacgagacattggaaggagaaaagcaagaagctatcacaactgctttcaagagccaattgcccaaaatggataaagttgagttcaatgtaatgacacaggcattgggagacaattcagctccggtgatgattactcaaagcgaatatatgcgtcgtatgaaggaaatggcaaatattcaggccggaatgagcttctatggagagatgccggatatgttcaatctggttctgaactccgaccataagcttatcaagcaagtgcttgacgaagaagaagcagcttgtcaccctgaagtagctcctatacaaacagagatgaatagtgtcagcaagcgtcgcaatgaactaaaagacagccaaaaagacaagaaggaagaagatattcctactgcagagaaagatgaattgaatgagctggataaaaaatgggatgaactgaaaaataaaaaagaaggcatctttgcaggatatgccagcaacaacaaggtaatccgtcaactcatcgacctggctttattgcaaaacaatatgctaaaaggtgaagctctgaacaacttcgtgaagcgcagtattgagctgatttaataccgcccctttatttataacataaatcaatgaaagagcattcaacactaaaacgtgttgcaatgctcttttttcatcataaaacgaacgctaaaatatcgataaattggaaagtattgtatatatttgaacactaaatgataaatacttcaattgtttgatttgggttatgagaaaaatacttttagtgttaattgctatatggttattcatgccgactgtctgtgcccaaaaagtaggtcttgtcttaagtggtggcggtgccaaaggattgacacacatcggcatcattcgcgccttagaagaaaataacattcctatcgattatattacaggaacttccatgggagccattatcggctctctttatgcgatggggtattctcctgatgatatggaagaattattgaagtcagaagactttaaaagatggtattctggacaaatagaagagaaatacgtataccacttcaagaaaaatgtcccgacaccggagttttttaatatccgtttctcattcaaagactcattaaaaaacttcaaaccacaatttctgcccacaagcgtagtaaatcccatacagatgaatctggtttttgtagatttgtatgcacgcgctacagcttcgtgtaaaggcgatttcgacaagttgttcgttcctttccgatgcatagcttctgatgtctacaataaaaagcaactcgtaatgagaaacggagatttgggagatgccgtccgagcttccatgagctttccctttatgtttaagcctatagagattgacaatgtgctggcatatgacggagggatctacaataatttcccaacagacgttatgagagacgattttcatccggatattataattggaagtgtggtatctacaaaccccaccaaacccaaggaaaatgacctcatgagccagatagaaaacatggtcatgcaaaaaaccgactattctattccggattcaatgggtattctgatgacattcaaatatgacaatgtcagcttgatggattttcagcgaatagatgaattgcatgatatcggatataaccgaaccataagcatgatggattctataaaaagccgtatacaaaggagggttaatttggataatatacgtttgagaagaatggtataccgaagcaactatccggaattacgcttcaaaaacatcattattgacggagccaatccccaacaacaggcatatattaaaaaagaatttcatagctctgacaataaggaattcacttacgaagacttgaaagaaggctatttccggctgctttcagacaacatgatttccgaaatcatcccgcacgccgtatataatccgaaggacgaaacgtatgacctgcatttaaaagtcaaactggaaaataattttgccgtacgattaggtgggaatatttccacgtccaactcgaatcaaatttatctcgggctcagctatcaggatttaaattactatgcgaaagaatttctttttgacggtcaactcgggaaagtctataataatgcacaattcatggctaagatcgacttttctactgcgatcccgacctcttaccgctttatcgcatctattactactttcgactattttaagaaagacaagttattttccagaaatgacaagccagcatttaatcagaaagacgaacgcttccttaaacttcaggtagggctaccgttccttttaagtaaacgagctgaatttggaataggaatcgccagaatagaagacaaatatttccagagaaatatcatcgattttgagaaagacagattcgacagaagccgttatgatttattcggcggctctatcagcttcaatggaagcacacttaattcacggcaatacccgacacaaggctacaaagaagctcttgttgcacagatattcatgggacgggaaagattctatccaggtgaagagaccaaaggagttcaaataaataaagaacaccattcctggctgcaattatcatatatgaaagaaaaataccatacgatgagcgaacactgggttttgggatggtatttaaaagctttgtacgcttccaagaacttttccgagaattatacggcgactatgatgcaagcaggtgagttttcacctactctacatagtaaactcacctataatgaagctttccgcgccaatcaatttgtgggagccggcattcgtcccatctatcgtctcaatcaaatgttccatctgcgaggtgaattttatggttttatgcctatatatccgattgaaagaaactcattaaataaggcatattatggaaaagccttctctaaattcgaatatttgggagaaatttctgttgtgtgtcaattaccgttcggagacatctctgcttatgtaaatcattatagctcaccgagaagggagtggaatgtcgggttaagtatcggtttccaactgtttaattaccgtttcatcgaataattttctacaaaaaaaagtcgccgaatgcttgctaattcgggaaaagtacgtatctttgcacccgttaaaacgaaacaatggtcgcgtagctcaactgaatagagtagctgactacggatcagccggttacaggtttgaatcctgtcgcgatcactttttcggaaaaacagaatggccgcgtagctcaactgaatagagtagctgactacggatcagccggttacaggtttgaatcctgtcgcggtcacttctaccaacatttaacaaggtcgcgtagctcaactgaatagagtagctgactacggatcagccggttacaggtttgaatcctgtcgcgatcaccaaagtcctctgcattttttttgtggaggattttgttttttaccccattccatcgaagaaattcggcatcacgagaaaaaaattaagcggttattttatctaaatcgagcgatcatttcacatcaaacgaccgtatgattatgtacaatcaataggatgttttacaaaaacactttaatagttattttcaaacatcaagaagtttactttcaaacattggaaagtttaaaaagtgcatggcaacgtatgttcaaacaatgcactttcatcttcaccttttgctcgaaaccactataaacaagcggatacaggatgaagggaaagcatttcacttttatactacattagtttatcaaatatgctattagcttatcggattttgctattagctaatcaaattatgctaatagcaaaaaatagaaagaactaaaaaaaatccccttcaccttgtatctgcctgttcatgggaggcataacaaaaaggtgaagggggaatacctatttataaaatgtatggagaatcgatacttctcagtatcagatcaacatttaatattcagttcgtttaagactttacgtattgcctcaaatgtcgtaattcgagtcggaaccaacggcaatcgaagtttattttcaatcatccccattgcattcagcatggattttactcctgccggatttccatccacaaacaaaagatcaaatagctcagtaaatcgatgatgaatagtgagtgcattagcaaaatcaccttgaagcgccaaacgtgtcatacggctgaattcacgcgggaaagcattgccgattacagagatcactccaacagctcccaaggttattaacggaaaagtaataccgtcatcaccggaaataacattgaaattatctggtttattcttgataatgtcatccatttgagtaatattaccggaagcttctttaatagcgattacattactaaaattacgagcaatgcgcaaggtcgtctcagcagtcatatttactcctgtacgccccggcacattatacaacacgataggaagttccgtagcttccgatatggctttataatgctgataaattccctcttgcgatggcttattataatatggcactacagacaatatagcgtcaactcctgtaaaatcgtcatttttcaatgtttctactattgcacgtgtattgttaccgcctacacccagcaaaataggaattcttccgttaacgcggtcaatcaccatctttttgatggttttcttctcttcttcggtaagagtcggtgtttcggctgtagtccccagcacacacaagaaatccgcattattctgcaatagatagtctaccaaacgcatcaacgcatcataatcaacgctttcatcctctttgaaaggagtaatcagtgctacccccattcctttcaatttagtctgtatcatgagttttaattataatctctaattttattaggcgcaaaagtacgaatatttttcatatcttacgatataagtttcagaaattcgtcctcgcttagtatggttactccaagtttttttgctttttccagtttggctggccccatattgtcaccggcaaggataaaactggtcttagcagagatacttcccacattcttaccgccatttttctcaataaggtctttatattcgtcccgtgaatgatgcgtaaatacaccgctgatcacaatagactgaccagctaatttatccgtatatccactcatatcttcttctgtacgatagagctgtaacccagcctcttttaacctgccaactaactctcggttagactcatttgagaaatacagaagaatgcttcgcgctattttttccccgatttcatcgatacttatcagcttttcaaggtcagcctgtcgcagctcgtcaatgtccccgaacgacttggctattttctttgctaccgtctcgccaacaaaccgaattcccaaagcaaagatgacacgttcaaaaggaactgtcttactctgctcaatccccgtaataatattctctgcagatttttctcccatacgatccaaccctttgatatcatcggctttcaattcatacagatccgccgtattatgaatcaaccccaaacgatagaacatatccaccgtttcaggacccaatccatcaatattcatggctttccgactaataaaatgctctattttacctttaatctgagggggacatgcagtttcattaggacaataatgggcagcttcgccttcatatctaattaatttgctgccacattcggggcaattggtaataaacctgaccttctcaccaagcataaaactacgggcatctttatccactcctgtaattttaggaatgatctcaccacctttttctacataaaccatatctccgatatgcagatcaagcccttcgataatatccgcattatgcaatgaagcacgtttgacaaccgttccggatagctgaacagcatctaagttggcaacaggagttacagcgcctgttctgcctacctgataagttaccatattcaatcgtgtcaatgcacgttctgcctgaaatttataggcaatcgcccatctaggagatttcgccgtaaaaccgagattcttttgttgtctcagactatttaccttcaagacgattccatcagtagctacaggcagattctttcgttctacatcccaataattgataaattcaaaaacctcttccaacgtctggcatttacgcgtcaaatcagagattttaaatccccattttgcggcttcctgaagattttcataatgtccatcacaaggcagattatctcccaaaagataatataaatacgcatccagcttgcgagaagctacaatagaagaattctgaagcttcaatgttcctgaggctgcatttctcggattagcgaaaagcggctcctcacgtgcttctttttcgcggttcaactcctcaaatacttcccagggcataaggatttccccacgaatctcaaaagaagaaggataattgtcaccatggagcacaagtggaatagaacggattgtctttacattatctgtcacatcatcgcccttttctccatctccgcgtgtaacggcacgaaccagttttccatcttcgtaggtcagagaaatggaagtaccatcatatttcatctcacagcaaatctcaaaatcctcattcaacgcttttcgtacacgctcataaaaatctgtaacttcgccttcagagtacgtatttgccaaagacaacatggggtatttatgtgcaacctgcgtgaaattcttgttaatgtcactgccgacacgcatagtgggcgaattttcatctttatattccggatgtgccagctccagatcctggagttcacgcatcttatcatcaaactccttatctgaaatttcgggagcattcaaaacgtaataattatagttgtgccgatgaagttcagcacgcaattcctctattttttcctttatatccatatttcttcgattgtttaaggcaaaaatacaggtttatctttgaatatttgtacttttgcgaaaaattataaagattatgcgtattgatattataacagttttacccgaaatgattgaaggcttcttcaattgctccatcatgaaacgagctcagaataagggacttgcagaaatacatatccacaatctgcgcgattataccgaagacaaatatcgtcgtgtcgatgattatccttttggcggattcgccggcatggtcatgaagatagagcctatcgaacgctgcattaacgctctgaaggctgaacgcgactatgatgaagtgatttttacgacccccgacggagaacagttcaatcagccaatggccaacagcctttctttggcccaaaacctgattatcctttgcggacatttcaaaggtattgattatcgtatccgtgaacacctgatcaccaaagaaatcagtatcggagattatgtgctgacaggaggcgaactggcagcagcagtcatggcggacgcaattgtccgtatcatccccggagtgatttcagacgaacagtcggcactttctgattcttttcaggataatctgttggcggcacctgtatatactcgtcctgctgactataaaggctggaaagtacccgatattttgttatccggccatgaagcaaaaataaaagaatgggagctacagcaatctttagaacgaaccaaaaaacttcgcccagacttactggaagactaaaagatatatgtaaataaaaacgacggtgagaaatatgagaattttcaccgtcgtttttatttatattctacaagaaagacaaatctgttattttactcttcgcactgggaatcttcttttcatctatcattccggccttgattttactcagtatacttaaaaagtaaaatagcatttttctttcatattatatgcgaagagttattgtatgttttcaattatacctcaagcgcaccaataatttcttttactgacttacatccgtgtctttccaagtaattatttataccatcttcaactttgattgtaacagccggatctataaaatttgccgtaccaatctggatcgcagaagcaccggcaagcataaactcaacagcatctttccagttcataatacctcccaatcctatgacaggaatatttaccgcctttgcaacttgccaaaccatacgcaaggcaatcggtttcacagcagcaccggacattcctcctgtcactgttgacagaatgggacgtttacgttccgcatcaatagccattcctagcaatgtattgattaatgatacactatccgcaccactttcttctgctgcacgggcaatttctgtgatatcagtaacgttcggagagagtttaacgataagtgtctttttgtaagctgcacgtaccgcttttactacttcagaagcaccttttgctgacacaccaaaagccatacctccttgctttacattggggcacgagatatttagttctatagcaggaattttgtcaagttcattaatgatctctgcagttttcacataatcctcaatagcagaccccgacacgtttacaatcatattcgtttgaatgtcttttatacgaggatatatctgttccacaaagtagtcaacccccttattttgcagtcctacagcatttagcataccggaaggagtctctgccatacgaggatatgggttaccttcacgtttgtgaagagtagtaccttttacaataataccgcctattcgcgctatatcaatgaaatccgagaactcttcaccatatccaaatgtaccagatgcagtcatcaccgggttcttcatctgcaattcaccaatgtttacacttaaatctgccatagtagtttatttatattaaaaacaggaccttctttacatacacacaaatgtccttctgtcgtattttccacacaacagagacatgctccaattccacaagccattgtattttccaaagaaacttcacattctatctgattacttttggcatattttgccacagccatcatcatcggtttaggaccacaagtataaatctgctcaaaatgtacctgatttaatatagaatgctgggtgacgtatcctttttctccgtgacttccgtcttctgtagtagtatatacctctccatatttagcaaattcttccagctgcaacaagtctttattgctacgagcccctaaaaggaaggtaggtttatgaccatttttcgccaattgttcacctaaatataacataggggctgttccgacacctccgcccacaagcaaaagcttatcagaaggcttttgaggcattgtatagccattccccaaaggaagtactacgttgatcacatcgcccgaatttacttctgctaaacgtcttgttccgtctccaatcaactgaataaggaaccacacttcgttttgtcgcttgtctacaaaattaatagaaataggacggcgtaaaaatgtagtagatgaaccgtccacccgaagttcggcaaactgccccggcaacatctcgggcagcaatgactgagaagtcaatttcagcaatacatagtttgcattcaatctgatattctcagtaactgtcagatctaaaataaatttcttcatgtatggatataaaagtataaattcgtattccggtgcaaagatacaggaatttgctcaaaccaccgattttacctctcatttttcaggtcgaaaggtttcataagtattatcatcaaagaatattcttatttcagtgatttttctggcaggcttttctatgtacctaatctcctgttttacaatctctttaggtgcattttcggctgttcttaatgccatttccttgcgattttccggattaatcgtctctttggacggatttacaggattctcatcaaacaaagaaggctgataatctccattggaagaaaccgtagaagcatcttctgcagatgttatcatttcgcctttaccataaagcaaccattcaagatttacataactataggtctgatgtaccttcattacaacctccaagcttggtttattccgatcattcaaaatatgtgagagagtagattgctgaactccaattgtctcagcaaaaactcttggaggaactttttctctctccattatcattctaattctgtcttttatctccatacagcttctttcttgttacaattgtatgtattaaacgttggtttcacaaaaatactaataaccactacggatatacaaaggtaaatattacaaatcacaaatgcaaattacaaatataaaaatattaatattacagatgtgtagcgatcattacgattggactaatacgtttgtgttgtatttagtgtataaaggaagaaattaatgatgaaaaactatattcaacagatcatagagttattcgggcataatgagtattcattggctacgcgtagaaaagtgcagcgatggttggctgacgacaatcatgcggaagaaaaaaaagaagcacttcacacgttgtggcaacaagcgggagaacagaaagtacctcgcggaatgcaacagtccatattacggatgcaacaaaatctgggaatgcagtctgtcggttccggtaaaaagtatcagttacttatatggagagcagcagctattttcctgttggcagtatcgtctgtttctatctatctgatgttggagaaagacaaactgcaaaaagacttggtagaatgtttcataccaacggcggaaatacgtgaacttacattgcccgatggtacccgggtgatgctaaattcgagaagcaccttactgtacccggagcagtttgccggtaagaccagaagtgtatatttgattggcgaagcaaatttccaggtaaagccggatgaaaaacatccttttatagtgaaagccaatgattttcaaataacagctttaggtacagagtttaacgtgaatgcctatccggagaacaatgaactgattgcaactctgctggaaggtagtgtgaaggtagaatttaataatctgatatctaatgtaatacttaaacccaatgagcagataacgtataataaacagacccggaaacgtagcctccaatcgcctcggatagaggatgtgactgcctggcagcgtggagaactggttttcagtgatatgcatctcgatgagatttttacgagtctcgaacgcaaatttccctatacctttgtttatagccttcacagcctgaacaataaatcgtatagtttccgtttccaacagcaagccactttggaagaggtgatgaagataataacgcaggtggcaggggatgtgaaatatataattaaggggaataaatgctatataactgataaaatatagaaaaacgattgttgaaccttttttaacttaatgtactatgcaaaaaagtatccggaagaaatggccgtttctcccggatgtgaaatcattgtccttctaatattagcgtatctcgacgctatttcaattgatcatagaataataaccaattaactaatactaaaaagatgctacaaatttacgaaaaaagagcagataatgttgttcaaaagcgagtctttctcatttttttaggtctattattgatgcagacccttgcttttgctcaaagtgatagtaaaattactatccagcagaaagatatcactgtagtagatgcattgaaaactgtggaaagacagtcgaagatgtctataaattatagtgattccgaattgaagggaaagaaaattgccgatcttaacttggaagacgtatcggtgactactgcactcgacgcaatcttgaaaggaacaggtttctcttatcagattcaaggtaattatattatagttacggagaagaaaccggcagctgcacaatctgtcaaagatatcaaagggaaagtaaccgatgagaatggtgaacccctgatcggagtaaatatctctgtggacggcagttctacagggacgattacagactttgacggaaacttttcgattaaaagtcccggtaatgcccgtttgaaaatatcttatataggatatgcaactcaactgattgctgtttccaataaggacttttacccgattacaatgaaacaagatacggaagtgctggacgaagtagtcgtgacggcattgggtatcaagcgggcagaaaaggcactgtcttacaatgtgcagcagataaaaagcgaggatataaccggcattaaagatgccaacttcatcaattcactgaatggtaagatagccggtgtaagtatcaacaagagtggtagtggtgtcggtggtgcgacgcgtgtcgttatgcgtggcgctaaatctatcgaaggcgacaacaatgcactgtatgtagtagacggtatccctttgtttaatactaatatgggaaacacagatagtggtatcatgggtgaaggcaaagccggaacggaaggtattgctgatttcaatccggaagatatcgagagtatctctattctgagcggaccttcggctgctgctttgtatggtagtagtgcggcaaatggtgtcgttctgattactactaagaaaggacaggaaggcaaattacagatatcattttcttcttcatccgaattcagcaaagcgtacatggtgcccgaattccagaacacgtatggaaataaagaaggtatgttcgaaagctggggtgacaaactggcccgtccgaattcgtatgatcccaagagtgatttcttcaacaccggaaccaactttatcaactcgttgaccttgtctaccggtacaaagcagaatcaaacttttgcttcggtttcatccaccaattcaaaaggtattgttcccaacaattcttatgaccgtctgaacttcaccattcgcaatacagccacttttctggacgataaattgcagttggatttaggagcgtcctatgtgaaacaggaagataaaaacatggtatcgcagggacaatactggaatccggtgatttctgcctaccttttcccccgtggagaagacttcgaagatatcaagactttcgagcgttatgaccagagccgcaatattccgatacagtattggccgattgccgatgcaacctatggttcgcagaatccgtactggactgcttatcgcaacatcgcaacgaacgagaagagccgttatatgtttaatgtcggtctgagctataagatcaccgactggatgaatcttgccggacgttatcgtatggacgatactcatgttcagtttgaacgtaaggtttatgctacttccgatcagaaatttgccgaaggaaagaaaggtctgtatgattacagcaattacaaagaccgtcaggagtatgccgactttatgttaaatatcaacaagcagttcaacgattttaatatttctgccaacttgggttatagctactctaactactggtcgctggcaagaggctacaaaggaaccttgctcggagtaacaaacctgtttgccgccagcaacatcgacccttccaacggtcgtatctcggaagacggaggtgacagtcgcgtacgtaatcacgctatctttgccaacgtcgaactgggctggagaagtatgctttatcttacattgacaggtcgtaatgactggaactcccggttggtaaacaccagcgaagaatcctttttctatccctcggtaggtctgtccggtattatctctgaaatggtgaaactgcccgagttcatttcctatttaaaggtacgcgggtcttatacggaagtcggttctccggtatcacagtcgggacttactccgggaactgtgaccactccgattatcggtggtgcactggctcccacaggcatctatccttttactgatttcaaggcagaacgtacccgttcttatgaattgggattgagtgtacgtttatggaataaactgagtgccgaagttacttactataaatcgaatacatacaatcagacctttattggcgatttaccggaattttcgggttacaaacaaatctatttgcaggctggtaatgtgcaaaatcacggttgggaagcatcgttgggatacagagacagtttcggagactttagcttctcctccaatctgaccttctcgcgcaatgtcaatgaaatcaaagaaatggtggaaaactatcgtactgacatgagccccgagcccatcaacgtacccgaagtaaggaaagacaacggacgcgttatattaaaagtaggcggcagcatcaacgatatatatgccaatactttcctgaagaaagacagtcaggggtatgttgaaatcaagcaagacggttcgtacggactcgaacaaggtgaacccgttttcttgggcaagacgtcaccggactttaatctaggatggagcaactcgctgtcatacaaaggattcggactcagcttcctgattaacggacgttttggtggtgtggtaacttcctctacccaagctattctcgatcgcttcggagtatccaaagcatctgccgaagcacgcgatgcaggcggtgtcttactgcccggacaagggagagtggatgcgcaatcgtattatcagctgataggtacgggtgactataccacttccggatattatgtgtatagtgcaaccaatatccgtctgcaagagctgactttgagttacaggttccccgacctttggtttaagaatgtgctgaaagatgttactttgtcattcattgccaataacccctggatgctctatagcaaagctccgcacgatccggaactgactccgtccgtaggaacttacggtcaaggtaatgactattttatgcagccgagtgtgagaagtttcggtttcggtattaaatttaaattataactgacccatgaaaaagataaatcaatataaactattagcaggaatttgcgctttgtcgctctttactgcttgtgacttcgaagagttaaacaccaatccgttcgagatgaccgacgaaatgggtataagagatggtgttgctgtcggaggtgctgttatggcgatgcaaagagctgtaatcaccgtaggaactcaggctgacgatacggaggccatcaaccagtatcaggttgcatacaatctgtcagccgattcgtggagcggatttttcggacagaataataactggtatagtggtagcaacaatactacctattacttacaggacaattgggtggcggctacctataccaactcatatacgacactgctgtcttcctggaaaaagataaaacaagaatccgaaaagaacgaaacaccggaaatctttgctttggctcagattctgaaaatatctgcttggcacaaaacgcttgagtctttcggtcccattccttacacccatgcaggagaacctgcactggtgatacctttcgacagcgagcaagttgcattcaatgccatgtttgccgatctgacggccgctatcgaagccttgacagtgagagcggaacaaggggcaactattgttgccgattatgatgccgtatatgccggtgatacgagaaaatgggtgaaatacgccaattcgctgatgttgcgtctggcaatgcgtatcagttatgcggacgaaacgactgcacagaaatatgcccgtcaggctttgaatcatccgtttggagtgatgacttccaaatcggacgaggcacagatgagcaccggagccggaatggtatttcgtaacaacatcgattggctggccaatcaatacaatgagtgccgcatgggctcttccatgttttcttatttgttgggctatcaggacccgcgtttgagtgcttattttgaagcttctcccagtgcgtatgcggtagcggcttttgatggaaaaaactatcaggcggtgcctcccggcaatgccaatcagcagaatacgatttataccgatttctccaagcccaatattacctcgaatactccgacttactggatgcgtgcttccgaagtttatttcctgagagctgaggctgcgttgagatggggaagcgaatttggtgatgcggaagcactgtacgaacaaggagttgccacgtcatttgatgaaaatggtatcagttcgtctgtagacgactatctggctttcggattgactccgattgcccataatatgagagcctcctattacagttacaatgctgcggctcctactactgcaacacccgcattcagcggtggaacggaacaaaaactggagaagatcatgatccaaaagtggattgcattgtatccgaacggtcacgaagcatggactgagtggagaagaaccggttatccgaaactgaatcaggtgcagaccaaccgcggacagggcgttactcgtgaaggtggtattcgtcgtatggtgtatcctgtaagtttctatcagtcggcagaggatagagccaattatgaagaagcattgaagctcttgggcggtcttgataaagacaaagcaactactcagttgtggtgggattgtaaaaataaaatctattaaactatgattcatatgaaaatgttaagacgattattatatatacttcctgttatagggataatgattgcgtcgtgtgtcgatatagagagcaaggactttgaacatatcggcggttacaacacgatggacaatgaagaaagtgcacagtattatgccgatcttcgtgcatggaaggcaaccagtcagggttacggacgtcctattttcttcggatggttcagcaactggtctcccgagggacctattcgtaaaggatatttggcttctttgccggacagcatcgacatggtatcgatgtggagtggtccattcggcttgaatgaagcgaaactggctgataaggagattttccaaaagaagaaaggcggtaagatcacggtttgttacattctgcataatattggaactggtattacgcctgcttccgtttcagaaaaagtacaggcggaaaacccgaatgcttccagtgaggaaatcacggaactggtcaataaggcaacagaagcttattggggatttaccagtggagagaaaggtgctgaagaccatatcgcagccattcaacgttatgccaaagcattggtagacacgattgttgcgactgattatgatggtctggacattgactgggaacccgataacggtggtgacggcggaagatatgtaggcagtctgaaagaccgcagaggtggtccgcgtggtgagtttctgcattatctggtagaagagataggaaaatactttggtccgatggcaaccgagcgtccgaatggtaagtactactattttatgattgacggtgaaatatggaactctaacaaagaatctgctccttattttgactatttcatcactcaggcatatggtgactccaatctcgatcgaagagtgagtaccttgcaaagctggtgtggagaatattacgactatcgtaagcacatctttacagagaactttgagtcatcctggactaccggtggtgtacttttgactcaggctgcttataaccatgccaatggtccgaaaggtggcgtcggtgctttccgacttgataatgactatgataatgcccgtgattacaattttgtgcgtcatgctatacagatcaatctgcaggcttatcaggaatatatggacaatcaatctaataaaaatacagaacagcaatgaaacgtatcaaaatcttatatgcaggtgcactagttgcattgtctttctctagtgtgggttgcaacgacagcgaaagcgatctgttggaaccgaaactttactttgaaagtaatgtgataagagtggaagttgaagcggatacctacgagtgcgaattggtgtcgcggctttcaacgatggtgaagagtaatgtaaatgtgaactatcaggtaggagggcaggaccttgtggatgactacaatcataaacacgggacgaccggacagcttctggcgactgataactatgaaatgacaggaacttcttcgaccattaaagcaggcgaactgtatgctgatccctgcggattgtcggtaaagaacattaccaagggggaagacggggtaacgtatattctgcctgtaatagtgaacagtacggacattgaaaagataagcagttcgagcgttacttatattgtagtaaggaaaccaattattattgataaggtataccgtatcaatccgggctggcttgatgtacgtctgccgactgcttataaaacaatgggttctgtcacctacgaagcattggtttatgccgaacgttggaagaatctgggcaccattatgggcaatgaaggtactttgattatgcgtaccggtgacttgaatcatcctgataacgagcttcaaatggccggaagtgttgcacttcagatgcccgatgtatctatattcctgttgaatcagtggtatcatgtagcgttcacttacgatgcttctgcgggaatggctactctttatctcaatggagagaaaatagcagaaaagacggtaggctcactgacattcgacttgaacgaacgtttctgcatcggttatgcttatgactatgaccggaatcgtaaatggaacggatttatgagtgaggttcgtttatggtcggtagcccgtactgcgaatcagattcgtgaaaatatgatgtttgtcgattcaggttcagatggtctggtcggttattggaaactgaatggagaagatatcgaacaacgggacggagtgtggtatgtgctcgaccagtcaccgaatcataatgacgcaacttccaataatggtttgcgtggtgaaaccggtggtagtcagtcttttgtagagccgacggtagtagatatgagggttcggcttgaataaatataggtttgttttctaggtagattaaatagcgggggctgaattctcaatgcagaattcagcccctattttttatttatatgaaatcctgattatttcttttatgtttctgtgaattactcggtaatatttttgttatattctacttccgtttatcttaatgtcggtattgggaaataaagttttgatacgttgcatctcttctttagtaattctgccggatagcttcaacctttcgattttcacttttgacagttcgtccggtatatcaatttcattaataaaggtaagctccaactgttttatttcttcaagtttcagcaggacggaagggaactctttcactctaaggttgatacccctgcctttggcatcggctttcaatctgtttatgagtccggtgttgtctgtgtttttctttttgaccatccagccaatttgtggtctcagtgcaaaattctcattgttttgtttgagtccgatgaaaccggaccacaactccagtggtgtttcaattacggtgtcattgtatgcttcaatatactttaaatcaacttttactatctcgctcggaagctttttacgacccacaatctgttttagattatttcttttcccctcattgtcgtaaggaaagaatttaatgatccatccatcaaaagtctcgggagctccgcatgactttggcgaatgacatttaaacatattgcgccaaaactcttggtttattgttccttttgatgccttcacaaactcctccaaaagaggttcaagttgtgaaatccaccattcgagtttatattcttttagtcctctggctttatttaaaactttttcccagtcttgtggtgtcccttcaagcgtgatttccggaataccgcaaacaatcattatggtgataaactcgaagtatgattttaccgtttccattattgttatttcagaaacagtcttttccaaagaggtcgttgtagagaaattacaagtgagtgtttcaaccaaatggcctcctacctcttttcttatctgttccgtaaactgcgggaaaatttcttcccataaaagactcgggtctttcagtttcttatgggattgtacaattaaagattcctttccggagaaatttacaaaatattttctcaaagactcatggttggcattcacatgttgggcaaaaccttgattaatcagtagccaaatcatatccggagataaaacgaacggcctatgatctgcataagcctgatacataccgcagaaaaaagaattatacccgaagtataataaactgtcaggagattcactcttggctattacattaaatggaggtttccagatgtctttttctgtaattcgaatggttgattcattgtcaaatagcatcagatatctgtagatttcatcaggggaagtcacgggatataatttttcgggcttggagagttgttcaacttcaaaagtaattccattttgagcaactatggaagtgctgcatagaatgaataaatagaatagtagttttttcataatactaaatttactttatggtttgtatttcaaatattttcctgttgatagattatagataacaatatacaaatatagtattattagaaatggaatcgctatgatatcgaatcttttttatgtcctgtgcttctaaaaaaataggcgcgtattattttagaggctgtttattcggaaaattatagtaagtttgctatggaatttgaatacaagtgtttcagcgtaagataatacatatcgatatggacgccttctacgcttctgtagaacagcgtgatcatccggaacttcgtggcaaacccttggcagtgggacatgccgaggagcggggagttgtggcagcagccagttatgaagcccgtcgttacggggtccgttccgccatgtcttctcagaaggcgaaacgtttatgtccccagcttatttttgtatccggaagaatggatgtttataagtccgtctcccgtcagatacacgaaatctttcatgagtataccgatataattgagcctctgtctttggatgaggcctttttggatgttacggagaataagaaaggaatctctctggcagttgatattgcaaaggagataaaacttcgtatccgggaacagttgaacttggtcgcatctgccggagtctcctataataaatttcttgcaaagattgcatcggactatcggaaaccggacggactatgtaccatacatcctgaccaggcgctggacttcatcgccggacttccgatcgaatctttttggggagtaggacctgtgacagcaaagaagatgcatttgcttggtattcacaatggtcttcaattacgtaaatgctcgctcgaaatgctgacggcccactttggaaaggtgggggcgctctattatgaatgttcgcgggggattgacgagcgtccggttgaggcagttcgtattcggaagtctatcggttgtgaacgaacgctggaaagagatatatcggttcactcttccgttatcatcgaattgtatcatgtagcggtagaattaatagaacgtcttcaacgtaaagagtttaaaggaaatacattgactctgaagattaagtttcatgattttagtcagataacccgaagtattacgcagtcgcaggagctgtatacattagatcgcatacttccactcgctaaagagttattgaaaagtgtggagtacgaacagcatcctatccgcttgatcgggctttctgtttccaatccgaaagaggaggcggatgaacaacatggagtttgggagcagctcagttttgagtttagcgattgggaataaagttcaggttttaccatcggtggaaattttatagaagctcaaatgaagtttctgtttataatcaacaggatgtttttcaaacggaacctctgtttactctgaatgaaggctctgtttgccctaaatagaaggtctgtttgctttgaacagagcgtctgtttcacgagagggctgagagcttctggatgtactttttttgaagtctgtacttttttgtcatgaggttcgtatgatttgctcaccttactttttgagagatgcgttatctttgccatacttaaacgaacaaaataccatgaatcgaatgaagcatttaatttgtgtttttctgttagctacctttggaagtttctctttcaaagccaatgcctatacagaacgcgatatgctgcaaaaagcggcagatgaaactacgttgaagaatgtgctggtaatgaaacaggcatgggtaccttatccggcctatactgaccgtgccgcttgggactcattgatggggtccaacaagcagcgtcttatcgcggcaggcgagaagctcctcgactacaaatggcaactgattcctgccaccgcctatcttgaatatgagcggaccggtaatcgtaaaatcatggaagttccctatgacgccaatcgtcaggcattgaatacgctgatgctggcagaactggcggaaggcaaaggacgcttcatcgatcagctactcaacggggcttacatgagttgcgaaatgaattcatgggtactgtctgctcacctgccccggcaaagcagcaaacgttctcttcctgatttccgcgaacagatcattgatcttggttccggcggatatggtgcattgatggcttgggtgcactatttcttccgtaagcctttcgacaaaatcaatccggtggtttctctgcaaatgcgcaaagctattaaggaacgtatcctcgacccttatatgaacgatgacgatatgtggtggatggcgttcaactggcaaccgggtgagattatcaataactggaatccttggtgcaactccaatgctttgcagtgtttccttttgatggagaacaataaagaccgtttggcaaaagctgtataccgttcgatgaaatcggtagataagtttatcaactttgtgaagtctgacggcgcttgcgaagaagggacttcttattggggacacgcggcaggtaaactttatgattatttgcaaatactttctgatggtacaggtggtaaaatatccctgttgaatgaaccgatgatccggcgtatgggagagtatatgtcccgttcttatgtcggtaatggttgggtggtgaactttgccgatgcttccgcgcaaggtggtggcgatcctctactgatctatcgttttggtaaagcggtaaacagcaatgaaatgatgcattttgccgcttatctgctgaatggtagaaaaccgtacgcgaccatgggaaacgatgcattccgctcgctccagtctctgctttgctgcaatgatcttgccaaagagactccaaagcatgatatgccggacgtgacttggtatcccgagacggagttctgttacatgaagaataagaatggaatgttcgtggctgccaaaggcggattcaataacgaaagtcataatcataatgatgtgggaacgttttccttatatgtgaataccattcccgtaatccttgatgcaggggtaggtacatatactaagcagactttcggtaaagaccgttacaccatctggacaatgcagagtaattatcataatctgccgatgattaatggtataccgcagaaatacggacaggaatataaagcgacaaataccacttgcaatgaaaagaaacgtgtcttttccactgatattgctgccgcctatccgtcggaagcaaaagtgaaaaactggatccggtcgtatacactggatgaccggaaactgacgatcaccgacagctacacgctggaagaggccgtagctcccaatcaggtgaatttcatgacttggggcaatgtcactttcccttcacagggcaaaattcagattgaagtaaaggggcagaaagtggaactggactatccgaccctgttcaaagccgaactggaaacaatccaattggacgatccgcgcctctctaatgtatggggtaaggagatttatcgcatcacactaaaaacaaacgaaaagaaagaaactggaaattataagtttgttattcaacaaattaaataggattcagcaagcagagtgaaaataagaaataacgtataaacaattaaatcgcagtaagatgaaaaaagtattattagttagtcttttggctatcgcaggagtaagcatcagtgcgcagaatctgatcaaaaatgaaaagtttgctacggaagtaacgaacaaggtaaccaatcctagcaaggctacggctggtgagtggttcattatgaataatgaggcggacggagtaacaacaatcgcttgggagcagactggagatgccaagtatccgaacgcgatgaaaatagataattcgggtgctgagaagaatacatcctggtataaagcatttcttggtcaacgtattacagatggcttggagaaaggtatctacgtgctgactttctatgcaaaagcaaaggaggcaggaactccggtcagtgtatatatcaagcagacgaatgaggaaaaaaatgataacggtaaactgaacaccacttttttcatgcgcagggattatgatgctgacgcccagcctaacgcttctggggcacagtacaacttcaagattaaagatgccgacaaatggacaaaggtcgttgtttactatgatatgggacaggtagtaaatgcaatcagcagcaaaaaatcaaatcctgctctggaagtgtccgatacggatgatgacgctgctatcctgaaagactgttacgtggctattcttggacagaataagggtggtgtagtagaaatcagtgatgtgactttgaagaagaaataaaaagaaagagcggagaaccagtgtggttgctccgctcttttcatgatatatattagtgtgtttaattacatggcaggctgcttcgtcagcagtttttgaagtttaccattcaaggtttggcacattgcaccgtttcccattgcttgataacgtttgatacggtactgtaacatcatgattttttcatttgcattctttttcataatttgtttcctctttttttgccctccacgttttgaagagcggttttacatcttgttttctttattaacactgcaaagatacaaaatgtttttgaattatatgctgtaaaacataaaaatcttctttttcttatgaattttctttttatgagaggttcggacacggagatgttacaaacctgttacaattttcccgtcctcttgataaatatattcttttttatctggaaggtaaaaagagactaagtgaaaaggaaattagtagactattaggcatatcgtctcaggatgatatgcctgattctcgcgaaattgatcaacggatttggatatatgtaaaagacaaggaatcgggtaaatctgcttttgagcaaattgaatatggaactaaaatttgggaatatcctaatttacgatattttaatggtggagataaagattccgctgtaattgatattgcaatttatgatataagtgttcatggagaaaaagggaagtctgaaaagttttcttcgcctgataagatttcattaaatatgtctgtctataataaatcggattctagtcttttgataggattgaatcctgatttatatggtagctttataataaaaaacggagaatattcaatgccacttatggcagatgtagaagtcaataggtattttggtgaatttcatgaatattctcccggtttatattccattgctcctcatggaagaatgagtttttatcttagcactgcacaacaacctattaaattgaaagatacgtctccacatgaatatgttcacaaattatatgatttattttacgactccatttgttatgtgcctgcacctactattattcaaatgcctgatactattcaagggattgtttggaataaagaatttacagcatatttcccttttggtagctggtatcatttttttgtaaatgacagtatatacgacatatatcctaatggtgaagtagctggatatgcgatggataagcatcgctataaatggtttgaagaatagtgcgaagcaacaactgaagaagatttttagtgagggtatattagattttgcaatattcctataaatctttaatttatatcataaatgaaaccgataattaggattttattaatcgtactattattagtcctatatagttgtaaaagtatagctttatatgatacttctactgattatgactttaaatttgatttatacagtcaagtaaagatgtattttcgtgcgaatttgaagtaccctactgtgaatgagctttgggactattgttggaaaataacgaatgaagttaatgataacacatttttatcatttgatgactttgataaggcggcatataaaaatgtctcaggtcgagaagagcttttgcagcatttatctttatataaaaaggaaatttcgttccaatttaagaaaggagcaatgtttgttctttggaagaataaaaaatggtttaaaattgagtttgatttaggtgaaatgatagctgataatggttataagtttgtttacttctatgatatgcaaggcaattacagtctggattttgactatgaagaagattttcaaaaaataagaaaggaagtacgtgataaatgcgtaccagatactacattgtggagtgaatttcacacgtgtctcctgagatttgatagaattaaaggatatcagctatattatccctcgaaaaataagattaaggaaaatatttaccttaaagaactaggatgtgctttggataattttcttttaaaccgaaatctgcaaatgattcaatttgttactaatttgcctcaatcgtatttgtataagtaaagtttatgcagtttctgtttgccctgatatggattggctaaataaagttaaccatattagggcatttcagttaattctactagtgctgtctttcattttaataacaactatattgaaccttgatattgtcttctttgtcagttttagtattctttcctttaaagaaaaaaacagtaattgattgatatcaagataaaactatggaaataacaggatcgtagtgaatgaacatgaactgaccaaaaagttagcttatgatagaataacccaaatgttttcatctgtttttaaggacttccacccataattctcctctttttctttcttttttctcgcaggaaagaatatatttgtatcctagtttaaacgaaaaccagtgtatgatatgataacaacccagttacttcgtcccgagagtatagttgtagtaggggcttcgaataatgtacataagccgggtggcgctatattgaagaatctgataaacggaggttatcagggagaactccgggctgtgaacccgaaagagacagaagtgcagggagttcctgcctttgcagatgtaaaagaattgcctgataccgatctggctgtgttggctgttccggctgtgatgtgtccggatatagtagagacactggcaagcgagaagcagacgcgggcgtttatcatactctctgccggatttggtgaagagacacacgaaggagcactgctggaagaacgtatactggaaagtgtcaacaaatatggtgcttcactgattggtccgaactgtatcggactgatgaatatatggcatcatagcgtcttcagccagcctattccgaacttgaactcaaaaggagtcgatctgatctccagttccggtgctacggcagtctttattcttgaaagtgcggtgacaaaaggattgcagttcaattctgtttggtcggtaggaaatgccaagcagattggtgtggaagatgtgctgcaatttatggacgagaactttgatctggagaaagattcccgtatcaagctactctatattgaaagtattcacaacccggacagattgctcttccatgcctcttcattaataagaaaaggctgtaagattgcggcgataaaagcaggaagttcggaaagcggaagtcgggcagcttcttcacatacaggagcgattgccagttccgattcggctgtagaggcgctgttccgtaaagccgggattgtgcgttgcttttcgcgcgaagagctgactaccgttggttgtatcttcaccctccccgaactgaaagggaaaaactttgctattattactcatgccggaggtccgggagtaatgctgacggatgctttgagcaaaggcggactgaatgtccctaagttggaaggtgaactggcggaagaactgaaagcccaactcttccccggagcttccgtaggaaatccgattgacatccttgccaccggtacacctgatcatttgcgtatctgcatcgattattgcgaagaaaaattagataatatagatgctattctggctatcttcggcacacccggactggtgaccatgtttgaaatgtacgatgttcttcatgaaaagatgcagacttgtcacaagcctatattccctgttcttccctccatcaatacagcaggagcggaagtggcggcattccttgccaaaggacacgtgaacttttccgacgaagtgactttgggaactgcactgtctcgcattgtcaacgccccgaaaccggcggtgcctgagattgaactgttcggagtcgatgtaccgagaatccgtcgtatcattgattccatcccggagaatggatatatcgaacctcattatgtgcaggcattgctgcacgcagccggtatttcattggtcgatgaatatgtttccaataaaaaggaggaagtcgtggattttgcccgtcgatgtggattcccggtagtagccaaagtagtaggtcctgtgcataaatcggatgtcggtggtgtagtactgaacattaaaggggaacagcatctggcacttgaatttgaccgtatgatgcagattcccgatgcaaaagcgatcatggttcaacctatgctcaaaggcacagaactttttattggtgcaaaatatgaagaaaagttcgggcacgtggtactctgcggtttgggcggcatttttgtggaagtcctgaaagatgtatcttccggcttggcacccctttcttatgaggaggcttattcaatgattcgctccttacgcgcctataaaattatccagggaacccgtggacaaaagggagtaaacgaggataaatttgctgaaattatcgttcgtttgtctaccttgctccggtttgcaacagaaatcaaagaaatggacataaacccgctcctggccactgagaaggcggttatagcggtggatgcgcgtatccgaatagaaaaataggactatttttctattcattgggacatattttctattattcagttgttattttgtctacatttgattagttgaataaaggagccttataaaactgaatatatgaaaaaaaatattataacgtttgttgccttaataattggtcttatttgccgtgcacagaccgtagatgagaattattattttaagagtcttagtagccagaatggattgtcgcaaaatacagtaagtgctatcttgcaggattcgaaaggctttatgtggtttggtacaaaagatggattggacagatatgatggtgtatcgttccggcattttaaatatgatagaaccaatccgcgaagtctcggtaataattttgtgacttctctttatgaagatgttgagggaaatatatggatagggacagacgtaggagtatatatctactatcctgaaaaagatacttttcgtcattttgtagaattaagtgatagaaatacaaggatagaacgcgctgttgccatgatttcaggggacaggcaaggacgtatctggatagcttcggaggcgcaaaatctattttgttatgacttaaaagaacaaagtttgcggaactatattttgacagaacattcattggtctctactaacgtgaaatgtttgacagttgataatagcggtactatatggattggattctacggagatggactattttattcgaaagataatttgaaaactcttcacccctatctgtcacctgttgataatgaagaaacttataatgatgatgttgttagtaaaatagtattaggggcatacaattgtttatatatcagttccttaaaaggaggggtgaaagaactgaatttgacttcgggcaaattgagggacctgttgctgaaagacgagaataatgaggctatttattgtcggactctacttgtctatactgataatgagttgtggatagggacggaatcaggtgtttatatttataatcttcgtacggaaaagtatacgcatttgcgtagttccgaatatgatccttattctttatcagacaatgctatttattcgttttgtaaggaccgtgaagatgggatatggattggttcatattttggaggagtaaattactatcctcgttcgtatacttattttgagaagtattatccgaaaggaatagaaaatagtctgcatggtaagcgggtacgtgaattttgtcgggatagtcaaggtatattatggattggtactgaggatggtggattaaatcgtttcaatctgaaaacgaaagacttttctttttttgctcctagtgcaggatttacgaatatacatgggctttgtttagtggatgataaactttgggtaggtacattctctaaggggctaaaggtgatagatacccgttcaggtgttgttttaaaaacatatcaaaaaaatgattctccccgttctttgattgataatagcatttttgcaatctgtaaaacagctacaggtgatatttatttgggaactatgtttgggttggtacgatacaataagcaatcggatgactttgatcgcataccggaactaaacgggaaatttatatatgatataaaagaagattctgccggtaatatctggttggcaacttatgctaacggagtatattgttataatgtgaacgatcggaaatggaagaactatgtgcatgatgataaagataatacaagtcttccatataataaagtatcgagtgtttttgaagattcccatcgtcaaatctggttgacgactcaagggggaggattctgtatatttcatccggagtcggagacttttacgagttataactctactaatggattgcctagtgatgttgtttatcagattgtagaagataaagaagggcagctatggctgacaaccaataatggtctggtttgtttccagccaaatactgaggctatgaaagtgtatactactgcgaatggtttgttgggagatcagttcaactatcgctctagttttgaagatgagaatggaatgatttactttggggggattgacggttttatcgcttttaatcctaaagatttctcagagaataagaatcttcctacagtagtaataactgattttctgttgtttaataaggaagtgtatgcagatgaaccaaattctcctttggaaaagagtataactttctctgataagatagtacttcgggctgatcagaactccttctcttttcgtatttcagctctaggttatcaagctccgagaatgaataaattgaagtataaattagaaggatttgacgatgagtggctatctgtaggcgaaagcccgctgataacttattctaatctacgttatggtcattatatatttcgggtaaaggccgccaatagcaatggtgtatggaatagtaatgaaatctcgttaagtatccagattctacctcctttttatctttctgtttgggcttattgcatttatgtacttttgattattggatgttctgtctatttggttctttattttaagcgtcgcaccaatagaaagcatcgtcgtcaaatggagaaatttgagcaggaaaaggaacgggaagtgtataatgccaaaatagattttttcactaatgtagcacacgagatacgtactcctttgacgttgattaatggtccgttggaaaatattcttttgaaaaagtcagtggactcggagacgcgtgaagacttgaatataatgaagcagaacacagaacggctactaagtctgacgaaccaattgttggattttcgcaagacggagagtcagggtttccgattgaactttgctgaatgtaatattacggaggtattgaaagaaactcataaacgttttacttctttggcgaagcaaagagaattggatttcattctaaatgtaccggtacaggatttctatgctcatgtaaataaggaggcatttactaaaattgttagtaatctgctgaataatgctgtgaaatatgcagaaacgtatgtgcatgtgtacttggaaataaatgggacgggagaaaataagatgttttatattcgttctgtgaatgacggagttattatcccgaatgaaatgaaggaagagatttttaaaccttttgttcgcttcaatgagaaggaagatggtaaagttactaccggaacgggaattggattggctctttcgcgttcattggctgaattgcatcggggaaacttgacgatgttggaaagtgaagaagccaacgttttttgtttgtcgctgcctgtagaacaggatagtgtgataaaactagcttcagaacataaatctgtggaagagagtaaaacggtagaacgtcggatagaacagggggaaagtaagacaaataggcctgtaatactggtagcggatgataatcaggatatgctgtcttttgttgttcgtcaattggaagataattacatcgttttgactgcaaaagatggattggaagcattggaagtgctggataatcaggaagtcacattggtggtaagtgatgttgtaatgcctcgtatggatggatttgagttgtgcaaggtggttaagtctaaactggattatagtcatattccggtgattctgcttactgctaaaacaaatattcaatctaagatagagggattggaattaggggcggatgcgtatattgaaaaacctttctctgttgaatatctacaggcttgcatcgccaatctgattaatagtcgtgagaaactgcgtcaggcttttgcacaatcgccttttgttgcggccaatacgatggctttgacaaaagctgatgaagaatttatgaaaaaactaaatgaaatcattcagggtaactttcataatcctgattttagtatggatgatatagtcgattcattgaatatgagtcgctctaatttttatcggaaaataaaaggagtacttgatctgagcccgaatgaatacttgcggctggaaaggttgaaacgagctgcccaattattgaaagaggggaatgggcgtgtgaatgagatttgttatatggtaggttttaactcgccttcctatttttctaaatgtttccagaaacagtttggagtattgccgaaagactttgccggttagatagtatctcgtacatgcaggatctatatccccgttgcattgcgcatatatacacaatgtacagggcatatagatcctgcatattgcatatatatagcttatctgcctcttttttattgcaatattttatgtgcttttatgtggtatatgaaacaattatctcattcctgtttcatttggtatagatttgctattctttcttctatttgagacattattgcgatttattgggatatttatattacccaaaaactatctcatccgctaattttgtctgcgtcaatcagtcgaaacaataatctaattatatatgatcaaacatttaacacttttgggtacagctcttttattctcttctcaaattttattggcgcagtggaaacctgcgggagataaaatcagaactttttgggcagaaaaggtcgatgtgaataatgtattgccggaatatccgcgtcctattatggaacgttcggattggcagaatctgaatgggctatggaactatgccgtattacctttaggacaatctgctccgactacgtttgatggaaagatattagttccttttgctattgaatcaagtctttccggtgtaggaaaaactttggggatggaaaaagaattatggtaccaacgtgcatttaatattccttccagttggagaggcaagagagtattgctccattttggcgcagtagattggaaaactgaagtgtgggtaaacaatataaaagtaggtgaacataccggtggttttactccgtttacttttgatgtgactgaagctttggagaaatcaacgaataccctgactgttaaagtctgggaccctacagataaaggatttcaacctcggggaaagcaagttagtaaccctcgtggcatttggtatactccggtaagcggtatatggcagactgtgtggctggaaccggtgtccgagcattatattgcaggtataaagacaactcccgacatagatacaaataaaataaaggtaaaagttgaaacggatagcaatagacagtcggataggctggaggtaaaagtgtttgatggaaagcatctggtggctatgggaacctctataaatggtttgccggttgagattcccatgcctgctgatgcaaagctctggtcgccggatagtcctttcctgtatcagatggaagtatctttgatttctgcggggaaactggtggatcagataaaaagctatgttgctatgcgcaagtattcgataaaaagagatgaacatggtattgtgcgtttacagttgaataataaagacttgttccagtttggtcctttagatcagggatggtggccggacggattatatacggctcctacagatgaagctctacgctatgacattgagaaaactaaggattttggtttcaacatgattcgtaaacatatcaaagtagaacctgcacgttggtatacttactgtgaccagatagggcttatcgtatggcaggatatgcctagtggagataaaagcccggagtggcaaaaccgaaaatattttgagggaacggagttgactcgttctgctgaatcggaagagacgtatcgtaaagaatggaaggaagtgattgattgtctttattcttatccttgtattggtacttgggtaccattcaatgaagcatggggacaattcaagacacaggaaattgccgaatggacaaagcaatatgacccttcccgattggtaaatccggcaagtggagggaatcattatacatgtggtgatatgcttgatttacatcactatccgggaccggagatgtttctgtatgatgcgcaaagggctacagttttaggcgaatacggaggtatcggactggtgttgaaagatcatctctgggagccgaatcgtaattggggatatatccagttcaatacttccgcagaagctacagcagaatatctgaaatatgccggaatactgaaagatatgatttcccgtggattttctgcagctgtctatacacaaactactgatgttgaagtcgaagtaaatggtttaatgacttatgaccgtaaagtgataaaactcgatgagtcaaaattgaagaagatgaacacagagatttgcaattctttaaaataacaactaaatagcaaaactatatattatacttatgagaaagacactaattttgattttaaccttgtttgcagtctttacgactgttgatgctagaagtaagaaagaccaggaccgcgcattaatcgacaaagttgccatgtggcagatagatcatcagacgaaagtaaagcatcatgatcttgcatggaccaatggagttttgtttcgtggcatggtggaatgggcagactacacacaagattcccgctattatgactttctgatgcagatagggaaaaagcatcgttggggattcttgaaaagactctaccatgcggatgatcttgtgatagcacagatgtatatccgtatgtatgagaagtatcatgatccggtaatgattcagcctactatcgcacgagtagattcgatagtggctaagccttcgaaagctcgtttatggttaggtgcaaaaaactggtcggagcgttggtcatggtgtgatgctttatttatggctccccctgtctatggacagttgaacaaactgtatcctgaaaaaaactatctggattttatggatcgtgagtttagagaagctacagattccttatatgacgctgatgcaggattgtactaccgggacagaaggtacatcccgaaaaaggagaagaacggtgagaaagtgttttgggggaggggtaatggttgggtatttgccggactgcctttgttattacaaacacttcccaaagagcatccgacttataattattatctgaatatctacaaagagatggcttcatccgtcatcaaatgtcaggataagaatggttcttggcatgcgagtatgcttgatcccgaatcgtatccttcgccggaaaacagtgcttccgggttctttgtctatggtttgggatggggaattaatcaggggatactgaaaggtaagaagtacaagaaagctgctcaaaagggatggaaagcattgaagagctatgtccatgaagatggcatgcttggatatgttcagcccgtcagcgctgctcctgaacaagtcactaaagacatgaccgaagtgtatggtgtaggtgcattcctgatggctggtattgaaatgttgaaaatgaaataacctttttattaataattatgaaaacaaaaacaagagatttaagtgcatgcctgaaaaggcggctatggatcgccggcgtatgtctggcagctttttcttttctttctgtatctgttgtgtatgctgctgacgatattcagactattcagcagcaaaagaaaggaatgacgattaaaggtaaggttttgggtacagatggagaacctattattggtgcatctgtattggtgaagggatcgactaccggagtcgtgactgatttggatggtaattatacattggctaacgtttctaaaggcgctattctggaatttagttatgtaggttatgtgaaactgaccaaaacagtagggagtgaaacaacgataaatgcaatcttgtatgaagattcccagatgttggagggagttgaggttgtggctttcggtacacagaaaaaggaaagcgttatcggagctatttcaacggtaaaagttgcagaactgaaaacaccgtcgagtaacttgaccaatgcacttgccgggcgtattgcaggtgtgatttcttatcaaagaacaggtgagcccggtgtagatgatgcttctttcttcgttcgtggtgttactactttcggttataaaaaggaccctttaattttaattgatggcattgaattgacttctactgacttagctcgtttgcagcctgatgatatcgctagtttttctattatgaaagatgctactgctacagcgctttacggtgctcgtggtgcgaatggagttatcttggtcaagacgaaagaaggtcagaaaggtaaggcgcgattaagcttgagagttgagaactcaatatctgctccaactcaggagattgacttggcagatcctgttacttatatgcgtctgcacaatgaggcctatttgacacgtaatccgttagcgccgttgatgtactccgaagagaaaatagacaatactgtacctggctccggttctgtgatttatccggctacggactggagaaaggaattattgaaggactttacgatgaaccagcgtgtaaacttgaatattacaggtggtggcgatgtggcacgttattatgtggcagcttcctatagtcaggataatggtattctggaggttgataagaatagcaattttaataataacattaaacagagagtttatactcttcgctctaatgtgaatattaatgctactaaaactacagaattgattgtacgtttaagtggtgtatttgatgattataatggtccattgtatggtggttctgccatgtataatctgattatgaaaagtaacccggtattgtttcctgccaaatatcccaaagatgaggctcatgcatacactaagcatactttgtttggtaatgctgaaaatggacagtatctgaatccatatgcagaaatggtaaggggatataaagaatcaggacgttctaacctgagtgcacagtttgaagtaaagcaagacttgaaattcttgacagaaggtttatcagcccgcttattgttcaatacttcccgtatttccagttatgatgtttcacgtaagctgaatccgtattattataagatgactaattatgattatctgactggtgattatgctatcgatattatcaatccggatgaaggttcggagtatttgatttatgatccgggaggtaaaagcattacagctaatatgtatattgaagcagcattgaattataatcgtgactttggaaaacacggagtaggcggattgttggtttatcagttgagaaataatcttcagccaaatgcaggctcgcttcaggcatctttgccttatcgcaatgtcggtttatccggtcgttttacttatgcatataataatcgttattttgcagagttcaactttggttataatggttctgaacgcttccacaaaagtaaacgatttggcttcttcccttctgctggtctggcatgggttgtttcaaatgaatctttttgggacccgtttaagagtgttgtgtccaaattgaagttgagagcttcttatggtatagtcggtaatgatgctatcggaagtgggcgtttcttgtatctgtccgatattaacatgaatgatagtaaatatggagcaaatttcggatataactttgattatcatcgtgatggtatctcagtgaaacgttattctgatcctgaaattacatgggaaaaatctgctaagaccaactttgcacttgaatttactctgtttgatgacttgaatgtgacagccgagtactatacagaacgccgtaagagtattttgcagcaacgcgcttctattccggcatctatgggactttgggtgcagccttatgcaaacttaggtgaagctaaaggaagtggcgttgacttatcactggactataataaatattttgcaaacaaatcatggttgcagttgagaggaaactttacttatgcaactagcgaatatatggtgtacgaagactatgaatatccgggagcatggtggaaacaaaaagtcggttatcctaccaatcaaacttggggatatattgcagaaggtttgtttgtagacgataacgaagtggctaactctcctgtacaattcggagaatatggtgcgggtgatattaaatatcgtgacgtaaataaggacggaaagattactgatctcgaccaagtacctatcggatatccgaaagagccggaaattgtatatggttttggtgcatcttatggatataagaattgggatatatctgtattcttccaaggattggccagagaatcattctggattgactataataatgtttctccgtattttaatacagttgatacgaaagttgtaggaaatagggtaggccataatgcacttgctaagtttattgcagatagtcattggtcggaagataatagagatgcgtatgctgtgtggccgagattaagcccgacttctattgaaaataatagtaaaacgagcacatggttcatgcgtgatggttcgttcttgcgtctgaaacagttagaaatcggatatacgattcctgaaaaggtaactaataaagtcggtattaagaatcttcgattctatgttacaggaaacaacttattgtgcttcagcaagtttaaactttgggatcctgaaatggcaggtgccggtttaggttaccctgtgcagagagtatataatgttggactaaatttaacattctaaatctgatataaaatgaaaaaattacaattattaatattgaattgtttgattatcgttttatcctcctgtgattcatttctggatatcgttccggatgatatcgccacaatcgataatgcatttacaatgagattgaaaactgatctaatcgcttagttttttctttttacctatgcaaatatagcgatatgttttatagcataaaaataaagaaaaggaaaagattttgtttcggttgatttcttgatgtaaatcaagaaatcaactgctttttgatacaaaaagaccttattctgaaacatttttgcaatacgtgtgcggaaacgaaaatgtaatataactgaattttaaggaatattgctgttaaaatgatattgagcaaaggaaggtgacgagaaatggaacactgaaatcaactacaaaaccatgaaagatagaaatgattacgaattcttttccggaacatcgggtgatgatgggaagagtagtgtccattgtggtagctcctcctacagaaataggggccagcttgccgaaatacttcacgagtaacggggctcccagcaatgctatgatttcacgcatgatgttggataacaatgcgattgttcccaattccggacctttatattcggtgatgaatatactcgaaagggaatagtagccgaatccggctcccactgccatacagtctgaagaggttctttggctcatgaaaatgcctgctacggcgcatcctgccaatgtccccagtatcgtcatgacggggagaaacatcaggcggggattcagagaacggaaacttttcagtgtgttgggatcattaccgatactgatacctacgcagaacatcagtccgcaaagggcgtaatagcttagtttgctatccgtaaaatcgtaaggaatcagatgataaaacccgcaaagggtaccgagaatgaaaaatgagacgatgatcagacttcctttcatacttccgtctcctttcctttattccttatatataataggtaccagagtccccatgcgcaaagtatactgccggtcactgccgccagtgtgataatgagtgcttcgagtcccaatgtatgcagtcctttgatgatagcctcgtttcctcctacatcaatcccgaggaggaagagcaggacccatatcagcagggtgattattttatgtatccaagatagtcttttattacgtaacaggaagccaaaaagcattcctgtcagcataattccgatgatgataaacatagtaagtgcctgtttttggctgcaaagataattgaaatagatcgttgttcctaattaaagtcggtggagacgttcgtaaaatgaaaggaaactttcagcgaatttggaataaaaacagaaattgaagcctggtttttagtaagatgtctaatttaaattcatatatttatagccgtcaaattaatgtaagatatatgcggagactaaaactatattatttgtttttccacagtacgttgaaaataaacgttccgctgtctatattaggtgcacttattgtatcaaaagctgactggagcttgttttgggaagcttttccttatctattgggtggctggggaattgttgccagtttgctttataaggagtttcttgaaaaggaagcctactttttctattataattccggaattctgaaacggaacttgattgtctttgtgtttgctgtatattggtctgtactttggattgtaaaattatgcatcacttgcttgaaatagatagtattattaagaatttcggtaccaggcaactgctgactgatgtttacctgaaaataaatacaggtgatgttattggattgttcggcaggaacggtacaggaaaatccgtgttgatgcaaataatcttcggaacaatgaaagcagaccggaaatttatccggttggatgaatgtaaggtcctttcggctccttaccaacatgcaaggacaatagccttcctgccgcaacaaggctacttgcccaagcatgaaaagataaataaattggtagactgttacctggatgctaatgtcgttccctatttttatgaggatgatgaagttgcccagtcgtgtatggaacggcgtgtctcccaactttccggaggtgaacggagatatttggaagctaagttgcttttgctgggcaatgctaaatttgtcctgttggatgagcctttcgattatttatcctttcatttggtagataaactgatcgggttaataaaaaaacattcggaagagaaagggatagtgattgctgatcataattacgaaaaagtcttagaggttgtcaatcgacttgtcttgattcgggagggagtattgatggaactaactgataagcggggattggtggagcaggggtatcttttagatgaaagttacttatgaatcctgctcctatatttatttttgcaagtcatttcgggttattttccctgattcgaaccgtttgagatacttccgtgctgatacctatcattcccgtacctccatgtacattactgggatatctgagaggttcgttaattgtttcgtcataaacgtcggaatcgactagattgagtgctttcagatagtaatattctgtttccgtgatactcaacaaacggatgatgacatccattccttcataatatccgttgtaattgttgttgtatgggatggcgggatcgttgtagaccgtcattgtataggaggtatctctaaatcgcgaatcatcaaagacaccataaatgtttttagctgtgtcgaacagtccgttgtcttcgtcatctcctgtggaaggttgaccgtctgtcagtactatgtcttcgcgtccgataaatgaataagtgatatgctttgtccagtgaaggtaatcttctcctccttcttcgtggttgtatccccatagtcgcatttgtttatctactacaatgcggtagaagtttgcctcgttcgggcggtctttaaaagttattttgtagcgcatgtagtcttgagtatgtccgttttgtattagcgggacggtgagcgtgtcgatgttttctattttatcaaggcgttgcggaacggtgacttctgcccaggcatgatatttgccgtcatcggtcatggcatcaatacgcactacttctcccgaagcaaatttgcctgtgatgttgaaccggcattgcttgtcatactcagtttccatcgggagtgggcgcaaggtctctcttaactctccgttgacgtgaacctctacagtggcattttcaatgtggttggcatagtcttttcccgtcaggttaaggaataagacatttgtcagactgtcagcgttaatgaatgcattcattaccaatttaggaggattatcctttatattaaaagggagttcattttcacaagatactgtcaccagtattataactagcaggataagcggatgatatatataagttttcatgttaacttagaatttgtaagtgtaagtaaaagatggaatgcaggggagcagggtatattttttgatcacactttttccatcgtcattatgagagcgaaatacccatgccggattcatggagttgtatgcattataaagactgatgttccagatacgcattccgtgcttggtctttttattgaaattaatccctatgttcaaccggtggctcgcaggcagccggtaattattgcgatgttctatgtaattggcctctccaacattaggggaattgttataaataggattgtagtagttatcgaatcccagaataaagccattgtttgctccattaccaggacggatgatggttgttttttcttcgggaatagtactggttcctcctgtgtaaaacacccacgaggcaccgatgtcaatacgttcgctgaatttatggttgagagtcagattaataatatggcgccgatcatatttgtatggaaatcgctctccattgttgatagcacctttagcaaatttgcggtcgcttttggataaggtataagacaaccagcctgttgtcttcccgagcgttttttgagccataaattcaattcccatcgaacgtcctttccccatttcaactttgctttcccatccggtggaagaaccgaaaaaactgactccgtctttatattccagcacattgtacatgtctttgtaatagccttctactgagaactcccaacctttgatacctgtataatatccccccaatgaatactggtgggatcgcatcggtttgattttttttgtgacaggcacccataaatcagtaggcatagcgatgggcatggacgaaagcagatgtacatattgactcatctttgtataagatgccttgagaattacgtctttacttagttgataacgtgttgagacacgcggctgcaaggagaaataactttgtttttgtacttgaaacagagaaaagtgtaatccaagattaagccgtagacgagtaccgatttttaggttatcttctgcataagccgatacttcatgtgcataaatccggctgttgttcatgctgtggtaagtagtgtcgcgaaatgcctcagagtctaccttgtctgatattttggaggtcatcacttccggacgaaaacggtgatagatatatcctgctccaaatttaatatggtgcataggagatgggttgtaatcaaaatctatctgataattccagtcattgatacctgaacgatagtctgaagagtatcggttgatgaaggttgtgttattggtgagtgaatattgattattcgaatatgcacttacattgaataggtagttgttgtaggaaactgtcgtgttgctaaacaggcgattattgaaaatgtagttccatctggcggaaatgattgtgtttccccagttcattttacttccgtccttgaaatcgctattatcatcatattgggtagcgaagtgatctttcccgttataagcactcagatataaacggctccggtcggaaaacttgtgattgatctttgcattgatatcataaaagtaatagttgtatttctcatcatcgggcatgaatggtttggctattaaatcaatatacgaacgtctggcggatatgttgaatgatgttttgtctttcacaatcggtccttccaaatttattttgctggttagcaagccgatactgagtgtcccatgatattttttcatatccccgtcattggtgcgtacgtcaatgacggaagaaaggcgtccgccgaagcgtgcaggaaaggaacttttaaataaagtgacctttttgatagcttcaggagtaaagacggaaaagaagccgaacatatggtctacgttatataccggagttccgtcaagtaagatcagattttggtcgggactgccaccacgtatatataatccagccgatccgtctactcctgcctgtactccgggcattaactgaatggctttcattacatctgattctcctaatatacttggagtattcttgatttgcaccattggaatctcgacagctcccatctgtgtggcaactgtccctgcttctgctttatctgaaacgaccactacttcttctaattgtgcgtttcctttcatacgaatattcagcagagtatcttgagcaagggtgaaatgatgtgtttctgtggtatatcccaaataagagaaacgtaattccgtttctccttcgggcagagtgatactataaaagccgtaaggattggtagtagtgccttgatattgatgactctcaatgatattagtaccaatcaacgtctcggacgacgtcccgtcggtaacatatccgctgatagtaaacttgcggcttaccggcttttgcacccttttcttttgcaggagaatgtatctctcagagaacttgtaactgatcggttcatccttgaatacgagatccagtatctcatgcaaaggcatatctttcactttcagattgattttatggctgatgctgatttcttcactgtagataaaagaatatcctgtagagttttcgattaacttgacgaactccttcaatgtagcatttcgcaatgtgattgtgagtcgggcatttgcattctgtgcgtatgcctgtgcggtgataaggatcaccatacctatcagaacgagcgttctgataggtaggtgtccttggtgaatagttctcatttagtctagtttttagtaatagtaatctgttgagtgtttcgtgaatagttgaaataaccggcattatgcagtacagataaaatcgcatccaagtcttctccattacggaatcgcgctgtgatccgataatttcgcaaggttgagtcggcaatgtgaatggttgttccgaacgagttggaaagttcgcgggcaatctcctgcaacggcagatcatcgaatatgaactccccgtggcgccatgaaatttcatctccggcattctccagtaccttgcgagtaagcttttgttccaccttattatatatagccgcctcattcggtttcagcaccatgcgtactgagttgtttttattgctgactgcaaccgaccctgttaataaagtcgtctttacatccggattatcgggataggcgtccacattgaagtgagtgcccaatacttgaacgtcaatcgtttctgtctgcactataaacggatgctttgggtctttacttacttcaaaataggcttctccgctcaactccacttcccggttatccgatttgaaccgttccggataggaaagggaagaataatggtttagcgtgacggaagtgccgtcgggcagatggacggtacgtgtttctgccaaagtgctaacagtctgtatggttgccggctgcatgtacagataagctgtccataccgatagacagagtaaaactactgctgccgctgccgcaaatgtgcgtgtcagatacaaccggcggttgcggaaattcagctttttctccagttgcggataactggatgctgctgaaaaacgtcctctcggtgagcgggtggaagcgatgagcttgttcagtatgtcttctaattctctatcggtatatttcatatctttttctatttagctttctttctaattccgtttcagcagaatcgtcagcttgcttacactgccttctttccactggggagtacaggataaggtaatgttctgctgtttcagtaccatctttttgggatataacttaatggtggtcgttgccgatttctgtcccgccttgatggtgactttggtttctgttagtttcataatcggtgcctgtcccgccggcaaagcaggagtggcaagtaacactgtcctgtcttctttggatttgtcggtggcaataattttaatctgcaactcactctcggattgattcttgtcacattctactgttcgggtagatttttcaaatcctacataatccttaggataattgtcattgtcgttgttgcaggaaaataggctcaggcatgctgttaaaaggacaaagagtccaacgtttgcgtcattaaactttttcatcattcaatcttttttagtgattaatcggtttatttgctgataaagaccggagattgacagaaactccctacgccttttgtgcaaataaaagttaatataaaaaagaagtgctgaacggttcgggtgatctccggttatccgctggacgaaatcatctctttcagtcgggagacagctttctgtagctgggcatcaactgtctttatgctgatatccaattcttctgctacttgggcataactttgtttttcttcacggatacggatgaatatttcccggcaacgttccggaagccggtcgagtgctttcacatagattgcaaacagttcttcactgattaatgactcttccggagaataactttgttcctgtggctccggcagggaatcggaatgaatggtggtgtacttcgactctttttccagataattgagagaagcgttcttgaccagaataaagcaatagtcctcgatgtttttcacatcaagaagagtgtcgcgctgcttccagagtttgaggaagatgtcgagtacgatttcctgcgaccattcttcctgtttcacataatagtaggctatgcggaagagtcggtcgtaagtcatgttatagaagtcgcggaaggctgtttgcgagtccagttccttcatttgccgtaataacttccttacttctgattcggtcatcggctgatcgtttagttttttaattaacccaaagcaagtcgctcataatgctgtcggagatgaaaattccttcccgtgtcaggcgtaaagccccctcgtggatttccagtttcccattttccagatagggggcagacattttccggcaatattcccacagttcattaccgaactcttgttttagtttttctataggtgttccccatacggtgcgtatggtggtaatgataaattcgttgtaacgggtcgtttggtccaggttttctgtctcaaagtcgcgctggtttccttctataccttttatatataggtcgatggaagatacgttccattcgcgtgtcgttccattgaatgaatgtgcggacggtccgcagcccaaatatggtattcccctccagtacgaagtattgtgacgggagtatttgtcggggcggcagaaattggatatttcataatgctcgtatcctgcattctgcaaatgttcgatcagcaatgtaaagaactgcagactggaatcttcgtctacttcctctatctgatgttgcttcaacatattatatataggtgtatcttcttcgtaagtcaaatggtaagcagaaatatgctctacatccaggcggatagcttgccggaggtcgtttacccaccgttcctttgtttcgccgggcagtccgtaaatcagatcaatgctgatattctgaaatcccgcttccctgcatctgcggacagcttcgacggctgtttgggagctatggcggcgtttcagtaattggagtgtcgtatcatcaaaagtctgtatccccatgctgatacggttgaaagggagcgaggataacatcttcagatattcctgggacagatcgtccggattggcttccagagtgatctcccggcagtgttccattccgtaattttcccgtatcgtttcaaagatgtgtttaaaatcagcttcctccagttgagagggagttcctcctccgaaataaatggtttctacaggttcgcctttcagatattctttccgcatttccagttcacggcagagggtatgcacataatgcgtctttaattcgctgcgggtagtcgaataaaagtcgcaatagatgcaacgtgtcttacagaagggaatatgaaggtaaatacctgccatagtagatgtttagcttgttaccaattgattatagcctgcaaatttaaaccttttttctgagcaattgatacaattaacgggaattaggtataagtctggcctgtctgctacccataaaacggaccttatgttacataacattgtttagtaacactgtcataaatattgcttttcccccaataaatccctaatttgcgcatcactaaattaatggtatgcgagaaacatactgagtaattactaaaatcttatatattatgaaagtatatcagactaatgaaattaagaacattgccttgttgggaagttctggctctgggaaaaccactctcgtggaagcgatgcttttcgagagtggtgttataaaacgtcgcggatctgttgccgcaaaaaacacagttagcgattatttccctgttgaacaagagtatggttactccgttttctctaccgttctccacgtagaatggaacaataaaaagcttaatattatagactgtccgggttcggacgacttcgttggcagtacggtaactgcacttaatgtgaccgacacagcaattattcttctcaatggccaatacggcgtcgaagtcggtacacaaaatcacttccgatacactgaaaaattgaataagccagttatttttctagtcaaccagcttgataatgaaaaatgcgactatgataatatcctcgaacaactgaaagaagcgtatggatctaaggtggttcccatccagtatcctattgctaccggtccgggctttaatgccttgattgacgtattgttgatgaaaaaatattcgtggaaacccgaaggcggtgctcctgtgattgaagatattccggcagaagaaatggataaggctatggaaatgcataaagcattggtagaagctgctgccgaaaatgacgaaggactgatggagaaattttttgaacaagattctctgacagaagatgaaatgcgtgaaggtatccgtaagggattgatcgccagaggtatgttcccagtattctgtgtttgcggtggtaaggacatgggcgttcgccgtctgatggaattccttggcaacgtagttcctttcgtgtctgaaatgccgaaagtggaaaacacagatggtaaggaagtagctccggacgtaaacggtcccgaatctttgtatttcttcaaaacgagtgtcgagccgcatatcggtgaagtatcttactttaaagtaatgagcggcaaggttcgtgaaggtgatgacttgctgaatgccgaccgtggttcgaaagaacgtatcgctcagatttatgtcgtagctggtggtaaccgtgtgaaagtggaagaacttcaggcgggtgatatcggtgctgccgtaaaactgaaagatgtgaagacaggcaatacactcaacggtaaagactgcgattataaattcaactttatcaaatatccgaattctaaatattcccgtgctattaaaccggtgaacgaagcggacgtggaaaagatgatgaccatcctgaaccgtatgcgtgaagaagatccgacatgggtgatcgagcaatcgaaagaattgaagcaaacgctggtacacggacagggagaattccatctgcgtacgttgaagtggcgtctggaaaataatgaaaaacttcaggttaaatttgaggaaccgaagattccgtatcgtgaaacgattacgaaggctgcccgtgccgattatcgtcataagaaacaatccggtggtgctggtcagttcggtgaagttcacctgatcgttgaaccttataaagaaggtatgcctgtgcccgatacttacaaattcaatggacaggaatttaagattaccgtgagaggtactgaagaaattccattggaatggggcggtaaactggtatttattaacagtatcgtaggtggttctatcgatgcccgtttcttgcctgctattatgaaaggtatcatgtcacgcctggaacaaggcccgttgacaggttcgtatgcccgtgacgtacgtgtaatcgtatatgatggtaagatgcacccggtagactcaaatgaaatctcctttatgcttgccggacgtaacgcattcagtgaagccttcaagaatgccggtccgaagattttggaaccgatttatgatgtggaagtatttgttccgtccgacagaatgggtgatgtgatgggagatcttcaaggacgccgtgccatgattatgggtatgagcagcgaaaaaggtttcgagaaacttgttgctaaagtacctttgaaggaaatgtcttcatattcgacagcacttagctcacttaccggcggacgtgcttcatttatcatgaagtttgctagttatgaacttgttccgacagatgttcaggataagttgattaaggattttgaagctaaacaaacagaggaataaacaataattctctcaaaactgttaaaaccgttgtcttttttaagtaaaagacagcggtttttgtttaactatgattaataaagatggaaaatcgcaaggaaaagatttaattttttattaaatttgcaaaccaaaggaggagttatattgttgtagtaatcagaatacaacctaaatagctctttacggttaatttccgggaacttccggttaaatcaagttaatgtgttaggagtgttaattagggagtgttaattttgttgctatgaagaagtcaacaatttggatattaagtattgtaatggggctttctttccttagtctgttgtatttgcaggtcagttatatagaggaaatgatgaaaacccggaaggagcaatttgattcggctgtgcgcaacagtctggatcaggtttccaaggatgtagaatatgcagaaactatgcgctggttggttgaggatatttcggatgctgaaagaaaagcgctgactgaaaacaatacttcattagggcagaataatgtagttcgggggacacagcgatttcaagtgaagtcacgggatggcaagattatttctgactttgaattgagggtgatgaagatcaaaccgtctgaacttcctaaagcgatggtacgtggacgaaacacgattcctcagacttctaattcgatgttggaagctatcaagaatcgctatatgtatcagcgggcactgttggatgaagtagtgttggacatgattagacgtgcgagtgacaagtcgattggtgatagagtacggttcagggaccttgacgattatctgaaatcgaacttatataataatggtatagacttgccttatcattttgcagtgattgacaaggatggacgtgaagtataccgttgtgcagattatgaagcaaaaggaagtgaagaatcctatcagcaggcattgtttaaaaacgacccccctgcaaagatgagtattctgaaagtgcatttcccgggaaagaaggactatatttttgattcgatcagtttcatgattccgtcactgatatttacgttggtgttgttggtgacattcatctttacgatttatatcgtattccgtcagaagaagttgacggaaatgaagaatgactttgtcaataacatgacgcatgagttcaagacgccgatatcaactatctcgctggcagcacagatgttgaaggaccccgcggtagcaaaatcaccgcaaatgttccagcatatatcgggagtcataaatgatgagaccaagcgcttgcgctttcaagtggaaaaggtgctgcagatgtcaatgttcgaccggcagaaggcaacactgaagatgaaggagattgatgcgaatgaactgatttcgggagtgatcaatacctttgcactgaaagtggaacgatataatggtaagataacatcgaaccttgaggcagccgatcctgttatatttgcagatgaaatgcatcttaccaatgtgatcttcaatctgatggataatgcggtgaaatataagaaagcggaagaggatctggaactgaaagtgaaaacgtggaatgaatcgggtaaactgatgatttcgatacaggataacggtatcggtatcaaaaaggaaaacctgaaaaagatatttgaaaagttctatcgtgtgcatacgggtaatctgcacgatgtgaagggctttggactgggactggcttatgtgaagaaaattattaccgatcataagggaaccattagagcagaaagcgacctgaacgtaggaactaaatttattattgcattacctttattaaaaaataattgatatggacgagaaactgcgtattttattatgcgaggatgacgaaaatcttggcatgcttttaagagaatatttacaggcaaaaggttattctgctgagttatatcctgatggagaagccggttataaggctttcttgaagaataaatatgacttgtgcgtgtttgacgttatgatgcctaaaaaggatggctttacgttggcacaggatgtccgtgctgcgaatgctgagatacctatcatcttcctgactgcaaaaacgctgaaagaagatatcctggaaggatttaagattggtgcagatgattatatcacgaaaccattcagtatggaagagttgactttcagaattgaagctatcttgagacgtgttcgtggaaagaagaacaaagaaagcaatatctacaagatcggtaagtttactttcgatactcagaaacaaattctggctacagaaggcaagcagacgaagctgactaccaaagaatctgaacttctcggactgctttgtgcgcacgctaatgaaattctgcaacgtgactttgctctgaagactatctggattgatgataactacttcaatgcccgtagtatggatgtgtatattacgaagttgcgtaagcacctgaaagaagatgattctatcgagattatcaatattcacggaaaaggctataagctgatcacaccggaagttgaatcttaatgagcactccgataaccacaaataaaaaatcccggaaacattcgttcccgggattttttattgatttctaataaattaatcagcgatcttcttattaatgacaatataagaaatgagtcccagtactacgaggaatactgaactgcccaaaaccgcgttgttgtttacattgccggtaaaggaacaagccaacaggatgaccactccgatcaagattaatatcaatcccaaattctttaataagcctttcatgcgtgtgtattttaatagattataatattccagtcacaaattaaagcataattctttaacgggcgaaataatttaggtgaaaaatccattataaagacagatttagtggattttatgaattaaacgattgtttttctgtttagtctttggtattgtagaataccttttttaagacctcttgcccgatgctcagttcttcgagagtgatgccatgcagagcttccttcagtgtctgccccgcaatgatgcgtgccttctcttccagttcttttccgtcttttgtcaggtggatcagattggtgcgacgatcttttttgtcggaaatacgtactacaagatgctgccgttccatgttgtctatgagacgggtcatgctgggtttgtctttaaaagttgcattgcacaactcttgttgtgtaacgccgtctttttcccatagaaaaataagaaccgtccattgctccgggctgatttccagaccgttctgacggaaattgcgatatagcttccggttgattgctgcggaaaccttaccatttaggatggcgaatataagccggatatcgaaattaaattgctctatcatgaaattattgtttaaacaactttgcaaaggtaagccacttcccggataattcctacattaggatacaaaaaaagattaaatatttgtagttcaaaataaaatgcctaacgtatatattcttttatttattaattatttttttgcggagcaaaggtaatgattatttttagatagcaaagaaataaacttcaaaacctgcggaattaaaggggtttcatcgtcattcacgattacaaaatcagcatgattccgcttaacctcatcgctcatttgcgcttcgatacgtttcattatcaattcccttgaagaatagtcacgcctaattgcccgttccactctcacctccaacggtgcatataccattactacaaagtctacttcctgcttaaagcctgcttccagaaggatggcagattccataccgaccatagctatatcacctttccctttcacccatcgcctgaagtcttctttcacctgcggatgaatgacagcattcacttttttcgcatgttcggggcttccaaatatataagatgctaataaaggacgattcaattctccattcaggaaaacatcctgtccgaccaaggcgcaaagttcccggcgtatcacatcattcgtatgagtgatacgcttcgcctcaatatcggaaatataaacggggattcccataatctccagcaatctggaaactacactttttccactaccgataccgccggtaatacctattttaatagccatcggaagaaacttgttctatcagaaaatcaacttgctcgggtacaatacggatttgattgattccacggggagccgacttcaacttcaccgtatatttatccgatcctaattttagcagttcctcataagaaacattaatcacaaaatcactggctttaatgctacgaaaacgctttaaacccacttgaaaagtaatttgaaccttcgatggaaaagcacggagcactttatctgccgggaagttaatcccacgtaacggcacctccacggttttctcagtataaatatcaacagggaaagtcagttcaaccgaggcgggaacaaacttcactccttttttattatccaaggcaacccgttgccgaatcgtatccgatatattttcaagatttacctcttgagtataagcggttgttatagtatccaaaattccggccggagcatataccaatacggaatccggactgcaaatggtatcagaaacataatattgaagccctgcagtcacttttccttgaaaatgaacgggtactaatttggacttgcctgtcgaatagatataatctaacgtatcaggttttattgaaagtatcttagaagaagcattcaattgactgagtatcttcttttcaaactcagaggcaaagattttcacgtgattattttgccctttatagtcagggaaactcagatttaccggaaagaaactcttccccaacatataattgagaagcactgttcctttatcttttacccggacgcgaagttcggaaggaggttccgaagtgagcacaatattattagggacatccttcatcctcaccgggatagagaattccgcttcatagtcattattaagagtctgaatcagccagaatccactggctatcaggaaaaaaaataaaaaaattaagaactccctgcttttatcactaagcaggaaatccttaattctcttggatagtcttaaatatgtatatcttaatttcctacgatcaagcatagggtatttgtttactaaagattatttagactgattgccggcagccgaagcatcagcaaaaatagaattcttatctattttaatcttcacgttagaagcgatttcaagtactatataatcatcagtaatctctttgattgtaccatggataccacctgcagtaattaccgactggtttacctgaagagatttacggaaattagcaatttctttctgcttcttattttgagggcgaatcataaagaaatacatgataacaaacatagctatcagcatgatccacatcatacttccacctcccgctgcgggagcttgcaataatacagtcaataagttcataaataatcaagttttagtttctactatatggacaaaggtatcagtttttagtcaacttaccttcttttttcaattgattaactattccatccagcgttccgttgataaagctaccgctcttggcagtgctatacaacttcgcaatttctacatattcatttaacgaaacacttaccggaatgttcgggaaacttaaaatttcggctaaagcagtctgcataatgataatatccataaatgcgatacgatccaaatcccagtttttcgtattctcgctcacaagatgacggtaatagtcagcattcagaattgtacgacggaacaagcggcgtgcaaattcctgatcttcgtcatccttgaattcgggaagtaattcctgatttgctccgttcttttcttcaaaacgcttaatcgttttcaagacaaaggtatctacaatctctttatcatcattccaatacagactctggtcttccagcacctgatcaagagaatcattattaaatatatatgttttatagagttttctccacagttcgcggtcagcttcatatgaattgtcaccggaagccatataatctttataaatatcgctttctactattttctcataaagctctttgacgaaatcctgatcatttgcccaagttcgcttctgattggatataaactcggtcagttgcttgttcacctccagctgtgcaacaaacttattatccacaaactttgtgttgggatacaactcttctttagtaggagccagttttgcttttgccgcatcaatgcgtttttgtgcatactctgttaatgccatcatcagcattaacaaataattataaaggtcatacgcctttgaaaggctgaagaataactctttctccgctgagtctagatttttgctgccattttggtaataggcatacactatttgtataatcttaagacgaataagaactctgttgatcataattcaaattaatactgttattatcgaactgcaaaagtagatatttttaatgagtttccacaaataaatcacattttttaatgcagtatttgattctctgcgctttttcttttgacagtttaaaaaaaatatccaattttgaggccgattattaacggacccaatgatatggaagattttaaaaagaaaatgaacgcagacatgaatgataaggagatcgttttctccaagtccatcaaagcaggtaaacgcatctattacctcgatgtgaagaagaaccgtaaagatgaaatgtttttagctattacggagagtaagaaagtggtgatgggagaaggagatgactctcaggttagcttcgaaaagcataaaatcttcttatataaggaggattttcagaaatttatggcaggattgacagaagccatcagttttattaaccacagtgacatgaacgattacatcagccgcctgaacgaagaagctgatataaaaagagaacaggaagctcttgccgaacaagcacaagaggacaagctggaaaacgaaattaagattgatattgacttttaaagaggtaactctttgatatttcaaaaaaaaacagtacttttgcaccgcttttttgcaacatcatgtgataatccacatcgtgtaatggtgaattaagcaaaataacttaatttagagtaacacaattttttaagaaatgaaatcaattgaagtaaaaggaactgcaagaactattgcagaacgctcttcggaacaagcaagagctttaaaagaaattcgtaagaacggtggtgtgccttgtgtactttacggagctggtgaagttgttcactttacagtgactaacgaaggtcttcgtaacttggtttatactccgcacatttacgtagtagatctggatatcgatggcaaaaaagtaaacgctatcctgaaagatattcaattccacccggtaaaagacaacattcttcatgttgacttctatcagattgacgaagctaaacctatcgttatggaagttccggtacagttggaaggtcttgcagaaggtgtgaaagccggtggtaagcttgcattgcagatgcgtaagatcaaagtgaaagctctgtacaatgtaattcctgaaaaactgactgttaacgtttctcacctgggattgggtaagactgttaaagttggcgaactgagcttcgaaggtcttgaactgatcagcgctaaggaagcagttgtatgtgctgttaagttgactcgtgcagcaagaggtgcagcagcagccgctggaaagtaatttgagattatccctgtaaagagatatagcaaaacgcagattaatgcagattaaagcagatgttcagtctgcattagtttgcgttaatttgcgtttctctttttatattcacgaactgttttttacgaaaaaacaatgattaaatatctaattgtcggactaggaaacattggacccgaatatcatgaaacccggcataatattggtttcatgacagtagaggcattggcaagaatcaacaatgctcctccctttattgacggacgctacggatttaccactagtttttcgatcaaaggacgccagttaatcctgctcaaaccgtcaactttcatgaacctgagcggactggccgttcgctactggatgcaaaaagaaaacatccctttggaaaatgtgttaatagtagtagacgatctggctctccccttcggcactctgcgtctgaaaggaaaaggaagtgatgccggacataatggtctgaagcacatagcagccattttaggaactcagaactatgcccgtttacgctttggtatcggaaatgacttccccaaaggcggacagattgattatgtactcggacactttactgacgaagatcgcaagacaatggatgaaagactggaaacagccggagaaatcattaaaagtttctgtctggcaggtattgatattaccatgaaccagttcaataagaaataggagtatgtacaattgactatttcacagcgtatatatgcaaacggtcattaagtactccaccatgacacatggtacactgttaattaataaattatcaatatatggcagaagcaagaatagataaatggatgtgggctgttcgtattttcaagacacgcacaattgccgccgaagcctgcaagatgaaccgtgtcactatcaacggagcatacgtaaaggcatctcgcatgataaagccgggtgatgtagttcaagttaagaagccgcctattacctattcattcaaagtgttgcaagctattgagaagcgagtaggcgcaaagcttgtacccgatgtaatggaaaacgttaccactcccgaccaatacgaactattggaaatgagtaaaatcagcggattcattgatcgcgcacggggaaccggacgtccaaccaaaaaagaccgcagaagtctggaggaattcacagctccggaatttatggatgattttgatttcgactttgatttcgacgaagataagtaaataatgaacggtgaataaacttatagcatgaagttacaagtttattcaccgttcactattttaccaactattggttagagatttgctttcacagcatcaattagttcctgatattcagcatcggtcaaataaacttttcccggattcatctggaatataccaccataatcaggtccgtctacatatttcggagccagatggaaatgcagatgagataatttatctgagtaagcaccatagttgatcttttccggctggaaagctttctgcattgcacgggtaacacgtgccacatcagccataaatgcattacggtcttcatcgctcaattcgttcaaatcatttacgtgatccttgtaagcaacgaggcaacgcccccgataagtttgctctttaaacaaaaacacacgtgatacactaagttgcgcaatctcaatcatcagattatgcaaagtttcattgttctggcaatacagacattcttttggatcactcttcatgatattcttatttttatgttttgacaaagcaaaaatagtcgttctgcttttatttcacctgtattttttcgtttttttgatcgactaattggtacacgttctctttttcaccgacaacccacactacatctccctcttcgaacggtgcatttacatccggcaccatcagagttccatcttcccgttccacaccggctatcatacaatgatacttatcccgtatacccgattcacggattgttttacccagaaaaacggagtctgcatcaataataaactgcttcaaagtcatctctcccttctcatacatctcccagtctatcttcgcaccactttgcatggcactgctaaatacattcaattgttcgtccgttcctattacctgtatcttgtccataggaaaaagacgcaccgagccaccgggaatattaatccttctcttcccccgcaagatagaagcgatatgaatgccatatttctttcccaaatttagttccatcaacgtttttcccgcccaagtggattcccccggaatctccaaatccgccaaatgcagatcatgagataacagacgtccggcatattcgggtttcttctctcccaaatattctgcacgcacctctctggaacgcagattttgaaagaaacgccgttctatcaatatagattgctttttcaaacgacgcgaccataccatcaacaagactgcaagcacagccactccaataatcaatccaatagatgccttaaacaatcccgatatcacaaaaatgacaaataacgccgcaatcataatacgtatgacaatagtagacaccaatggtgcacgattggcacggttatcatgccacagggtcataaattccaccgaatggtttttcttcaccatgatagcacgcaggaaaggcgaaatgcaaaggataataaaaacagcccccaataatgacgcccagaaatgaggcaggttctccttaaagaatgggacgacaaaacggaaagacagtgcaataatggatatactgacaattgaatataccacagttatgcgtaccattgccagcaacagcttcttccacaaattctcatgattaagtactgtttgcgagcccgaagaataacgcattaagaactttctccaggaagcgggtaaatgagcatccacaaaagaagaagccggttcagccagacgaatcatataaggagtcaggaaagtggttatcacagaaactgctaccactatcggatataagaaatcgctcgtcacgtgcagagatacacccaatgaagctataataaatgcgaattcaccaatctgagtcaaactgaaaccgcactgcatagccgtcttcaagggtttgccggaaagaatcacgccgaatgttccgaaggtagcctgccccaaaataactgcgatcgtaattacaatgataggtattgcatattcaataatcattgcaggatcgaccatcatccccaccgatacaaagaaaattgcgccaaaaagatctttcaccggcttcaccaaccggtcaatagattccgcttcgattgtttctgccagaatagaccccatgataaacgcaccgaatgcagcagagaaccctgtattggctgccatcactaccataccgaaacacagtgccaatgatacgataagcagagtttcctctcccatcagtttcctgcaacgcttcaaaaactccggaatcagatagatgcctactacaaaccacaaaataagaaagaacagcagtttaccaatactctccagcatctcggtgccttcaaagttatggcttaccgccatcgtagaaagcatcaccatcaatacaatagccagtatatcctccagaatcagaatactcagtacaagcccggtgaactgcttcttcctcagtcccaagtcatcgaacgccttataaataatagtggtagaagacatcgcaatcataccacctagaaacagactgtccatccgatgccagccgaatcccataccgacacctatccccagcaatatcatacaaaagatgatggtgcaggcagcgatgatagcagaacctccgacttttacgattttcttaaaactgaactccagaccaagagcaaacaacaagaagataacaccaatatccgcccatgtcttaatgttggcggtatccattactgatggtgtataaggcatgtgtggacttgccagaaaaccggcaaccacatatcccaacaccaaaggttgctttaacttcttaaacaacaaagtcataacgccggcacagatcaatatcagcgcaagatcggcaatgagtgtaggtaattgagacattgtttcatcgtatttggtgacaaaattaaaataaatctatcgtataaacaacagattcacggatatgtttcacatcaaccatcataaaataatttagccccggatagtatcaaaacctatccggggctaaaaattttataaactcaagatttattttctaaaaggtggcttcaccactattgccttcaatttacgtccacgcatatcaatacaaatttccgtgccaactttggcatattccggtttcacatatcccataccaataccaatcttgcgagtgggagacattgttccggaagtcaccacgcctataccttccccttcctcattcacgagttcatagccatgacgaggaatgcctcggtcaatcatttcaaacccaactagtttgcgggtagttccttctgacttctgcttttccagcatcggacggttaatgaactccttaccctccacaaacttagtgatccatcccaatccagcttcaatcggtgaagttttatcatccagatcattaccatacagacagaagcccatttccaaacgaagcgtatcacgggcacccagtcccaccggcttgataccgaattcttcccccgcctcaaacacagctttccatatcgcctcggcagcatccggatagaaataaagttcaaaacctccggcaccggtatatccggtattggagataatcacattctctttccccgcaaaccggccaacggtaaatgtataataaggaatagccgacagatcgatatccgtcaacttctgtaaagcaagaatagccttcggcccttgaacagcaagctgcgccatattatcggaagaattctccagctccgccccctccgtattatgagaaacacaccagttccagtccttttctatattggccgcattcactaccagcagatatttttccggctcgtagcaatataccagcaagtcatctacaattcccccttcttcattagggaagcaggtatattgtatcttaccgggaacaagtgccgccacattattggaagtcaccttctgaagaaaggctaacgcttgcggccctttcacccagaattctcccatatgggatacatcaaataccccgactgcattacaaacagtcagatgttcatcaataattccagagtactcgataggcatattatagcctgcaaattcgtgcattttagcacctaatgcaatgtgtttctctgtaaacggagtggttttcattttttgtgtattaagttttaagtaataaattgatattcgtggaatgtaatcacttggaagctaccagttcggcaatcttcacaatgacgttcattgccttctccatattctgaataggaacaaactcataacgtccgtggaaattaagaccgccggcaaaaatattcgggcagggtaaacctttgaatgaaagctgcgctccatccgtaccgccacgaatcggcttcacattcggcttcactcctaccgcctccatggctgcgaaagcagtgtcgatgatgtgcatcaccggttctattttctcacgcatattatagtattggtcacgtaattcaagtgtagccgtaccttctccatattcggtgttgacctgcgcaaccagacgttttatttcttccttgcgtttctcaaacttggcacggtcatggtcgcgaatgatataagacactgtactttgctctacatctccctgaatactgatcagatgatagaatccttcatacccttcagtctgctccggtgtttccgtcgatggcaacattgcgataaactgattagcgacacgaatcgaatttatcatcttattctttgcatatccggggtgtacattacgtcctttaaaagtaatctttgcagcggcagcattgaaattttcaaactccagttcccctacttcaccaccatccatcgtatacgcccattcgcagccaaacttcccgacatcgaacttatgcgcaccttcaccgatttcctcatccggattgaaaccgatacgaatctttccatgtttgatttcgggatgttctttcagataaacgattgctgatacgatctcggcaattcccgctttatcatccgcaccaagcagcgtcttgccgtttgttacaatcaaatcctctcctttatgatcgagcagttccggaaattgtgcaggagaaagaatgatattttcttcggcacaaagcactatatccgtcccatcgtagccttttacaatacgtggagttacatcttttcctgtcatatcgggacttgtatccatatgagcgataaacccgatagtgggtacttttttatctatattagcaggaagcgtggcaaaaagatagccatgttcatccaaagtaatatcttccaaccccaaagattccagttcagtcttcagatattcagcgaataccatctgtttcggagtactgggagtaagccctgttgattcatccgactgtgtatcaaagctcacatacttcaaaaatctgtctactaaagtcatatctattttacgatttaatgatttgcaatttacattttgatagtttatagtgccgtaaaggtaaaaaaagagccgtgaattgacaaacaattcacggctcttttttctcagtatattacttaaaagtgactgctaccatcaaaacaatgcgtacacactttacatttcggcagcccgatagcttcaatcaaagtctcaagcgtgttgaatttcaatgaagtcagtccgaaacgctcggctatgatactaaccattttctcgtattcgggagaccccgtagtggcgtatttctccagattcttattctcatcgccttccagttctttaataatacgacgggtaatcaactccaaagcattcttagaagccgagaaacccacaaacggacaggcatagatcaacggagggcaagcgatacgcatatgtacctctttcgctccataatcatatagaatcttcacattatcacgcaactgtgttccacgcacaatcgaatcatcacaaaacagcagacgctttccctgaagcatggcacgattcggaattagcttcatctttgcaaccagcgaacgcatttcctgattgctgggtgtgaagctacgaggccatgtcggtgtatattttgaaatggcacgatgataaggaactcctttaccttccgcataacccaacgccatacctactcccgaatcagggataccacaggcacaatccacttccgattcgtccttctgtcccatcttcattccactggtgaaacggacttcctctacatttttgccctcataacaagaggtcgggaaaccataatacacccaaaggaaagaacaaatctgcattccttcattcggttggcgaagctgctcgatatgatcgggatacatgcgtactatttcccccggtcccagatacttttcgatttcataatccagattcgggaaactggatgactcgctggtagcggcatacgcaccatctttcttgccgatcaccaccggagtacgtccccattggtcacgagccgcgataatactgccatcctctgtcagaatcagcagagaacaagaacccttgatatgtttgaatacgttctcgataccttcggtgaaggttcttccttgtatgataagcagtgcgatgagttccgtttgattggtgttgctcgaactaagttcggcgaagtgcatattttggttgagaaggtcttcttccagttcctggatattcgatattttagcgactgtgacgatggcgaagcggccgaggtgggaattgatgataatgggttgtgcatctgtgtcgctgataatgcctatgccggcattgcctttaaatttatcaagctctccttcaaacttggatcggaaatatgtactttccagattgtgaatggagcgaataaatcctttctcctgactataagtcgcgagtccgccccgctttgtacccagatgtgagttataatctgtaccatagaataaatcagtcacgcaactcgatttcgagactgttccgaaaaaacctcccatgttgttctctttattgataatgtttaaaaaaagatggcgcaaaagtacaaaaaagaatccatccgataaaaaaagcactccgcaaagttttaattttctttgcggagtacttctaaattttattaaaaatacaaagaagattgaacaatcgttttagtcgcgtctcatttccatttcttaattgatttccggtcggatggagctgcttcgataagactcaatgcaaaaccaccgctgcgtgccagcttgacggacatctttgttttattcgtaacgatccctttctttatctgataggaagtcggattcttttcgtagtcagcctcttttccgtcggcatacagggtagccacatactctttatccggttccagaaaatcaagagtaaacgcggcagtacgggagttttcgtcagtaataccgccaacaaaccaatgattggttccttttgctttgcgggctactgtaatataatcccccggttcggcttccagatatttgctgtcatcccagtccaaggctacatctttaataaactggaaagcatccggataacgctcataactttccggcaaatcggcagccatctgcaaaggactgtacattgttacgtaaagagccagttgtttcgccagagtagtacgtacaacgctatgcttcccatccagaaaagaaattctcgtgtcgaagatacccggtgtataatccatcgggccgccgatctgccgagtgaatggaagcaaagtagtatgaaaaggtttattaccggcaaaagcttcatattccgtcccccgtgccgattcattgccgatcaggttgggataagtacggcataatccagtaggacgtacagcttcgtgcgcattcacacagattttataatcggcggctttcgtcacggcatatagataatggttgttcatccattgtccatagtgatgttcgccccgaggaatgatattgccaacataaccacttttcacggcattatatccgttgtcaaccataaattggtaggccgtatccagatggcgttcgtagttacgcacggaggcagatgtttcatgatgcatcatcagcttcacccctttctctttggcatatgcgtttagcatcttcacgtcgaaatccggatagggagtgacgaaatcaaacacataatcttttgatttgccgaaccaatcttcccagccttcattccagccttctaccaatacctgatcgaaaccatgctgcgctgcaaagtcgatataacgttttactttgtcattgttggcagcgtgacgtccgttagggcttgtctttgagtaatccgtctgtccgagtttgacggaataaacatcatctgtatatgcccaactgctttttccggtaatcatctcccaccacacaccgatatacttcaccggtttaatccaagaaacatcttgataagcacatggttcgttcagattcaaggtcagtttggaagcaaggatatcgcgtgcatcatcgctcacaatcaccgtacgccacggagactgacagggtgtctgcatataacctttatctcccattgcatccggtgtcagccatgattcaaaaatcagttttttgtcatcaagattgagatgcatgcaggaataatctaccaaagcggcttcgtgcaggttaatatacagaccgtcggctgttttcatttgcagagatgtctgcacgcctgttggtgaaaaagacgtttgagaagcattgtcggtaatagcccctttcatcagtccacggatttctgttagtctggattctgtgtaatcatattcctgggtatcataatctcccggaatccaaaaggcagtatggtcacccgtcatggcaaactgcgaatgttcttccttaataacaaaataattcagattcttctgctgcggaaattcatagcggaaacctaatccatcattgtaaagccggaaacggatgatcatattccggtcctgcgccttctgattcagtgtgacagccatttcattataatgattgcgaatggatttcacttctccccacaccggctcccaagtttcgtcgaaggtggaagtttttgtatcgatgcacgcaaacccattcatcagtcccggatcattcttcaactcaagtcccaactttgatggtttaatcactccctttcctttataagtaagttcgtataccggttctccctgaacattgaccgaaaaatccagttttaattgtccgtcaggagaagtgatactttctgccattgccgttgcacccatagaaaaagagagtaacagacagagtactgccgtagttaatattttcatgttcttcatgatataaatgaattagttaataatcatatggcaaatgtagtgaggaatagcaagcgccacttcggattataattaaaatatagcgtttccgaatatttcaacactgataaatacctatcaataaagcatataccaaagtacttcaacagaaaaaatatagtgcttacatggagcaatatagcaccttttcacatccgacaaacgggatttttctttatttccccgcctctcttcagaaataaaaaaaatattttaatctcatactctcatcctatgacaactaatatatagacaatcagcacaatacagaatgagagatactttttaaatagttatctctcatcatttcctcatcaaatagctttctttttgactacctctcattcatatttcagttatctctcattcgtctcaaagccgataatccattgtactatggcaagccttacagaacatggaacctaccgctactttgtatataacatatctttaagttggctgcgttagcattatcaccatttggaaaggacatcgtaggagcataatgtaacaataagagaagtggctataacaaaaagttataatacataattagaaacaattgggttgtcttgattgtttgccgtacctttgcacccgcaaaattataaaaagataaaaaaatgatttcaagcgctacaaaaacgttgcaaaccaacaacaagacaatttacgttgcaatactttctactttaacttttttcttatttttagattatattcctggtttacaagcatggtccgcatgggtgactcctccggtagctttgtttctcggacttattttcgcattaacctgcggacaggcacatcccaaatttaataaaaagacatctaaatatttgctgcaatattctgtagtaggattgggattcggtatgaatcttcagtcggctttggcatccggtaaagaagggatggagtttactgttatttctgtggtaggcacgttgctcatcggctggtttattggtcgtaaaatcttcaagatagacagaaatacttcctatctgattagttcgggaactgctatctgtggtggtagtgctattgcggcaatagggccggtgctgagagctaaagacagtgaaatgtctgtggcattgggaacgatctttattctgaatgctattgcgctttttatctttccggctatcggacatgctttggatatgaccgaacatcagtttggcacatgggctgccattgctattcatgataccagttctgtggtgggagcaggtgctgcttatggtgaagaagcactgaaggttgctacaactatcaagttgactcgtgctctttggatcataccaatggcattcgccacttcttttatatttaaaagtaaaggtcagaagataagtattccctggtttattttcttctttattctagctatgattgcgaatacatatttgctgaatggcgtgccgcagttaggtgccgccatcaatggaattgcacgcaagacattgactattaccatgttttttataggtgcttccctttctttggatgttctaagatctgtcggtgtcaaacctttgatccaaggcgttttgttatgggtggtcataagtttaagtacattagcctatatctatttcgtgtaaaaagtgaaagaaatgtcccccatctgaattgtactgcgaggattcagatgggggacatttcttatgtttaagctaaaaataagctgtctcaaaacatcgaatgagacagcttatattatttatagttgaatcggttgagacaacttattttttattcaaggcttcgaagatcaatccttctaattcttcagcaagttcgggattatctttgatacataccttggctgcatcacgtccttgacccagtttagtgtcattgtagctataccatgaaccgctctttttgatgattcccagttctgcgcccaaatcgatgatttctccggagtgagaaataccttcaccaaacatgatatcaaattctgctttgcggaaaggaggtgctactttgttcttcaccactttcaccttagtcagtttaccaagaacttcttcaccgtctttgattggctggctgccacggatatctatacgtacagaagcatagaacttcaatgcgttaccacctgtcgttgtttccggattaccgaacatgacgccaatcttttcacggagctggttgataaagatacaagttgtacgtgttttgctgactgtaccggtcaatttacgcaaagcctgtgacatcagacgtgcctgcaaacctaccttattgtcacccatgtcgccttcaatttctgctttcggagttaatgctgctacggagtcaataacaataatatcaatagcggaagaacggattaactgttcggctatttccaaggcctgctctccgttgtccggttgagaaatccagagattgtctacatccacgcctaatttcgctgcataaaaacggtcgaaggcatgttcggcatcaataaaagcggcgataccaccggctttttgtgcttcggcaatggcgtgaatagccagagtcgttttaccggaagattccggaccatagatttcgatgattcttcccctaggatatcctcctacgccaagtgccacgtttaaagcaatggagccggtaggaatcacttccacttgttcaacactatcatcacccattttcatgatagaacctttaccgaagttcttttctatcttttccatggtagcctgtaaggctttcagtttttcgcttgatgccattttattatctgtttcaaaattaagttcgtctttctttgccataccttattcttataattaatggatttattgatttaaaatctgtgaggcatgctctttggttttcacttctttgggagtgataatccgttctatgattccttcttcattgatcaggaaagtagtgcggaaggttcccatataggcacgtccatacaactttttctctccccatacaccaaattcttctaccaactttttgtccgtatcggctatcagtgtaaaaggaagattattcttatcgatgaatttttggtgcgacttctcgctgtctacgctgacaccgattacttcgtaaccggctttgcgcagttcggaatagttgtcacgcagactgcatgcctgtgccgtgcaccccgatgtactgtctttcggatagaaatacagtactatcttttttcctttataagcactcagtcggatctcttcacctttttcattgatgcctaatacttccggtgctttatctcctatattcttcattctgattcgttctattatagttctaggtctttatcaaacacttcatgccaaggcagtccctgcttattgagctgttccatgaacggatccggattaaattcttctacattgtttacacccggacgttgccattcgcctttgaagaacatcatggcaccgatcatagccggaacaccggtggtgtagctgactccctgcatacctgtttccttgtaagcttcctgatggctgcagttgttgtagacatagtaagtacgttcttttccgtctttgatgccacggatacggcaaccgatagaggtttcaccttcatagttctcacctaaatcctgtgggttaggcaatactgctttcaagaattgtaatggtacgattttagttccgttataatcaacttcatcgatacgggccatgccgatattctgaatcacgcgtaagtgagtcagatattcttgtccgaaagtcatccagaaacgggcacgcttgatagtcgggaaatgcttgaccaacgattctagttcttcatgataaagaagataggaatcacgtggaccaatattaggataagtcagatctttgtggatttccagcggaccggttgtcacccattgaccattctcgtaataacgtccgttctgagtaatttcgcggatattgatttccggattaaagttggtggcaaatgctttatgatgatttcctgcattacagtctacgatatccagatattggatttcgtcgaaataatgtttggctgcataggctgtgtagattccactgactcccggatcaaaaccgcaaccaagaatggcagtcagacctgcttccttgaaacggtcgtggtaagcccattgccagctgtattcaaaatgagcttcatctttcggctcatagttggctgtatccaggtagttgacacccgccttcagacaggcttccataatggtaagatcctgataaggaagagcaacgttgattaccatttccggcttaaagtcattgaataaagctaccagttcatctacattatccgcatccactttggcggtttttatattgggattgcctatagctttgacgatattatcgcatttctcctttgtacggctggcaatcatgatgtctgtgaatacatcggcattttgtgccactttgtgtgctacgacagtaccaacaccgcctgcaccgataataagaactctacccatttcttttaattaataaattataaatcaaaaattaagattttagaattgttagcttggcaaatatacgtgattattttcagataatcaccgcgtcgctactcctttttatttgaaacgttgcaagatgccactctcaaattccagcgtttttccgttgtagaaccaagtttcgaaacgactgtctttttttaactgtatttctacaggatcacctattgacagacgacattcgtcggtgttcataccttcttccaaatcaccccgtgcgatgattgcccaatgtttatctgtgatagccggatacttctgatggatgtctccaaatccgaaaaggtcttcaatataattctcgtttttgacgataacatcatatttcaaatcaacctctgtttcataaagtgatccatgccaatcctccagtgagaggataaccagacttcccggaccggagatttttatttcttttattttcaaaacagtgtagcgaggcaaatgtatgcggttttccatttgcttgttttcaaggctgaagactctttttacagccaatgtccgtttcggatagacggtcagatcaatatatttgtctttcaaggtttccagatttccggactttttgctactgaaactgatggcgttgggaaaatatctcattttcttttcagcttggaaatcgctcacgtccataccggaattagtgcgggaaagagctacttccagataataggaatgtccctgcgaatcttgaaatatgattttcacgggatatgactgactgccaactcctatggcggtaatggttgcttcggtgttgaccggaatagacactttccgatatccggagtaactattggcgtcgtccacccgtgccatatcggactgaacatatatctttctgcctgtcagcaattcttttgccgtgtctacgtctttcagattaactaatccgttgatataggcacggggattcttttcgcaaatttcatccggacgtgtatttttaatctcataataatatttttctccgtcacattcgaagatgagtcgagtggaatagctcatgtcatttgatagttcttgagatttttcttcatatccggcgaaagtaagaatcttgtgtttcagaacgctgttgtctgcccctttttctgtctcatacaccaaaagggtagggaggaacatgtcacgtccggatggaataaacatgaatttcattccgggtgtccatttacataaaagttgcagtgggaagttctcttttatgaactgttcttcttcacttagagggccttcctgattggaaatagtagtaacaagataatcattttgcgctgtgatatgagaggaaccacaaccaaacaggattagaaataggacgattgttctcatatttatttactttagatgaactatgtaatcttattgtttgttttatagataatggcaaatgtatgtattttatatcgtattagatggtatttcccaatctttttgatatctttgcccccgattttaacttaaacgttataacaaaatgaagaaagtattcgtttcaatttgcattgccagcacagtacttgcaatgttttcatgccgttcggttgagaaggcagtcccattggcttcaatcaatggtgagtggaatattatagaagttaacggctcgaaagtaactccgggcgaaagcagaacccttccctttattacttttgatacagcgaccggaagagtatccggtaacagcggatgtaaccgtatgatgggtagctttgacgtgaatgccaagccaggcagcatggagcttaagggaatggctagcaccagaatgatgtgtccggacatgactaccgagagaaatgtgttaggtgcgcttgcacaggtgaaaggttataagaaagccggtaaggataaaatgtttctttgcaatgagtccaatcgtccggttgtagttcttgaaaaaaaggaggctgacgtgaaactatcagtattgaacggagaatggaaaataaaggaagtgaatggtgaagcaattacttcgggaatggaaaagcaacctttcattgcttttgatgtgaaaaagaaaacacttcatggcaatgccggatgtaacttgattaatggtggttttgaaactagcactactaatgctaaatcaatctctttccctggggtggctagcacaatgatggcttgccctgatatggaagtggaaggtaagattctgaaagcaatgaatgaagtgaagtcgttcgataaactttccggtggtggaatcggtttgtatgacgcaaataatgcgttggtgattgtacttgaaaagtaagatatacgtattatattaaataggtatgcctgtgtcgcacataacgatacaggcatattttttattcctttatgatctattcttttgctttattgaaccagagctgtttccatttgtttaatgagtcgatagctgtctggcttctatgtgacttgacagcagtcatttcgatttaaaactgtcgttttggcagaaaatatgtcacgtattcgtccgatttctttttggcacatggtttgttttttaatcagcgtccgtttgaaagcccttacaaagagaaagaaaacaaccggacaaaaagaaattgaataataataaataaaaagaataacgatcatgggaaaaattattggtattgacttaggaacaacaaactcttgtgttgccgtatttgagggcaacgaacctgtagtaattgcaaacagtgaaggtaagcgtacaactccttctgtggttgcatttgtagatggcggcgaacgtaaagtaggtgatcctgctaaacgtcaggctattactaacccgacacgtacgatcttctctatcaaacgttttatgggtgaaaactgggatcaggtgcagaaagaggttacacgtgttccttataaagtagtgaaaggtgacaacaacactccgcgtgtagatattgacggtcgtctgtacactccgcaagaaatatctgcaatgattcttcagaagatgaagaagactgctgaagattatctgggacaagaagttacagaagctgttatcaccgttcctgcatatttctccgactctcaacgtcaggctactaaagaagccggacagattgcaggtctggaagtaaaacgtattgttaacgaaccgacagctgcagctcttgcatacggtctggacaaggctcacaaagatatgaagattgctgtattcgaccttggtggtggtacttttgatatctctatcctcgaattcggtggtggtgtattcgaagttctttctactaacggtgatactcacttgggtggtgatgacttcgaccaggtaatcatcaactggctggtacaggaattcaaaaacgacgaaggtgctgatttgactcaggatccaatggctttgcaacgtctgaaagaagctgctgaaaaggctaagattgaactttcttcttcaacaagcacagaaatcaacttgccgtacattatgccggtaaacggtgtgcccaagcacttggtgaagactttgactcgtgcaaaattcgaatcattggctcacggattgattcaggcttgtctggaaccatgtaagaaagcaatgagcgacgctggtttgagcaactccgatattgatgaagtaatccttgtaggtggttcttcccgtatccctgccgtacagaaattggtagaagatttcttcggaaagactccttctaaaggcgtgaacccggatgaagtagtagctgttggtgctgctgtacagggtgctgttttgacagacgaaatcaaaggtgtggtattgttggatgttactccgttgtcaatgggtattgaaacactgggtggtgtgatgacgaaattgattgatgctaatacaacaattccggctcgtaagagtgagaccttctctactgctgccgataatcagagtgaagtgactattcatgtattgcagggagaacgtccgatggctgctcagaataagtcaattggtcagttcaacttgtcaggtatcgctccggctcgtcgtggtgtgcctcagattgaggttacattcgatatcgatgcaaacggtatcttgaaggtatctgctaaggataaggctacaggtaaagaacaggcaatccgtatcgaagcttccagcggtttgagcaaggaagaaatcgaaaagatgaaggctgaagctgaagctaatgcagaagcagacaagaaagaacgtgaaaagatcgataaactgaatcaggctgacagcgtgattttccagacagaaaatcagttgaaggaattgggtgataagttgcctgctgataagaaagctccgattgaagctgctttgcagaaactgaaagatgctcataagtctcaggatttagctgctattgatacagctatggcagaaatcaatactgttttccaaactgcaagtgctgaaatgtacgctcaaggcggagctcagggtggtgcacaggctggtcctgatatggatgcaggtcagaatgctggtcaggataatagcaagcatggtgacaatgttcaggatgcagattttgaggaagtgaaatgattccgataagggaacagataataaacaataagcaaaagcgtgcagctcaatgagttgcacgctttttgcatttatggggttcatggttgctatgtgttttctatgggcttttttatctcttatttgcgacatgtttgcgacacgtcttatttggcgataaggtacaacttaaattgatataaaccatttaaaacgagaagaatatgccaagaggaaattacactattcaaagaagttgcgaggagtgcggtaaaatctttactcctccgacattagtgtcgaagtattgttgccctgcttgttccaagagggcgtataagaaaagacaaatcgcaaaagagaaagaagcgatacgccaagcactgattagacgaataccatccagtaaggggtatctaaccgtaaaggaagctatgctgatttacggaattagtaaagacgttctttatcgtatgatacggcaaggcttgataccgtcatacaattttggtcagcgtctgatacgccttagtcggcagtatatggatgaacacttcaaaacaaaggcagggagtagaaagagaaaaaaggaggcattgtcctttgaacccaaagattgttacaccatcggagagatcgcaaagaagttccatatcaatgacagcagtgtgtttaagcacatacgccgtcattctattcctacacgccaaatcggtaactatgtttatgttcccaaatctgaaattgataaattgtataagtcgttatgaagaaagcattacccaataccaaagtgaccgtcaaactcagaaggtcgaattataaagaagagtggtatctgattatagagtcatacccagtgtataagcgaggttctaaacgggcaagccgtgtggtggaatctatcaacagaactatatccacacccatttgggataagtcatccatagcacgaatcttgccggatggaacattcaactataagcctaaacgtgatttgaatggaattatccaatgccgttcaacgatagaccaagaggcttgcatctatgccgacaatgtgcggaagttacggcagcatgaatacgatagtgccatcctatacactgataaggaaaacgaaatcgctgcacagaatgagcggagcgaacaggattttatcaagtatttcaatcgtattataagcacacgtcatcccaatagttccgattcgattatagtcaactggaggcgtgtaggtgaattattgaaaatgtattcacaagggcaaccaattccattcaaggcgatttccgttaaactgcttgaagatataaagatgttccttctccgtgctccaatgggagggaataagaaaggtactatctcacaaaacacggcatcaacctatttttccatacttaaagccggactgaaacaggcgttcattgatgaatatctgaccgttgatataagcgcgaaagtaaagggaataacaaacatagagaagcctcgtgttgcgcttaccatgaatgaagtgcaaatgttggttgatactccttgcaaggatgatgttttgaaacgtgcgttcttgttctctattctcactggattgcggcatagtgatattcaaactttgaaatggaaacaaattcagcaaacaagcaaaggtacatggcaagcagtagtaattcagcaaaagacaaaaaggcccgattacaagccagtcattcaacaggcacttcaactatgcggcatacgtccagacgatgatgaagcacttgtttttgaaggattgactgatgcctcttggatttctcgcccgttgaaagtctggatagaagcatccggtatcaagaagcacatcaccttccattgtgggcggcatagctatgcttcgctgttgctggaaaatggcgttgacatatacaccatcaagtctttgatgggacatactaacgtcaaaaccacgcagatttatacgcatatcgtaaacgaacaaaaagagaaagccgccaatacactgcatatagaaaatttggatttataggttgtggtggttatatccaccattgagcaccaacgacttatgtaataccaatcatatacttaccaccgtttacccctcatgaagcatcaactttttgaggggtattttgtagtatagaggtgttcagtaaagaatgtgttagtccaaacagtcgtttattccccatttattatgttgcccaataaattttcgtattaatgaaacttaaatctgtcagtggtaaatgagcggttgattggtggcggtcaagcacctatttagcacctataagcatccctatacttttgcggcataaattttaatacgaagaaaaaatggcctataaagtaaattcattggaggaaatgccgaatgcgttgtcctacctgattgagtccgtagaagtactgcaatctaaagtgaatgccttgcagcataaacaggcaagtaactcacccaagtggatggatatagatgagctttgtgcttatctgccatcacatcctgccaaacaaacggtttatggatgggtgtcaaccaaacagattcccgtacataaaataaacaaggctttggctttcctgcaatcagagattgacgattggctgaagaacaaatcgcacaagacccaagatgacttaatggaagaagccagacgatttgtcgaatctaaaaagattatcagatgatggaaacgaccgactattgcttttcattctttcgcaagcccattcaaaacatcgaaccgatgagggctataggtattgtggatgtgtatcgttatgtcatcggacattatgcccaaccacaaaccgagaacctgcggcagatgcagtcctctcccgaagccaaaaggtacaaagccacccattttgactattgtactttttcgggattattccgaaaacggaatgaaaaggaactgattatgcactcaggattgatgtgtttggatttcgatcatgtggataacatagggaggttaaagcaacaattacttaaccatgagtattttgatacagaactgttatttgtcagtccatccggtaatggattgaagtggataatacctgttgatttgaaaggctgggaacattcccggtacttcaaggctgttaccaactgtatcaaagcgacaggtttgccattggtggatatgtccggcagtgatgtggctcgttcatgcttcttaccctacgacccacaagcatatattaaccctaaatacaaagatgatgtcgaagaaaatattttccgcccaagattgggagaatgtcccttctgaaatacaacaggcacatacaccaagtattgcccctatatataataaggtggaggatgatgtggaaagtgttgttcgggagatagaacagtgtgccattgatatagcccctcattataaagattgggtggagttgggctttgcgcttgtggatggattgggagagaacgggcgggagtattaccaccgcatcagcaggttttaccctacctatcaaaaggaagaaacggataaacaatacacgcattgtctgcactccaaagggcaaggcattactatccgttctttcttccatttggcaaatcaagctggaatctcattggctccgttcttcaaagagcatttatccattttgccaaatatccaaaatggtaaaacgggtaaatggataaaatcagaagaagaacttcctacatttcctgaatgtgtgtttgagcatcttcctccttttctaaatgaggttgtcaataattccatttcggtagatgaccgtgatacgatattaatcggggctattgtgtgtttgtcggtatgctttcataatgtttgtggcgtgtacgatgaacgcattgtttatcccaacctctatctgtttgttgtagcggatgccggtatgggaaaaggagcattgactctatgccgtgaattggtagcccccatcaaccgccatttgcatgaactttccaaacgattggaacaggaatataaagaagcaatgaacacatatattaaaggtaagaaaaccgatggaatggctatgccaactgaaccgcccatgcgtatgctcgtgattccagccaatagtagcgcaagctctttcttgaagatattaggagataatgacggaatcgggctgctgtttgaatcggagggcgacacgttaagtcagactttgaaatcggactacggcaattactccgatgtgttgcgaaaggcattccatcatgaattggtaagtttgagtaggcgtaaggatagagagtattgtgaagtagccaatccgagagtatcggtagctttggctggaactccagaacaggtaagaagattgatacctgatgcagagaacggattgatgagtcgcttttgtttctatattatccgcttcaaacgaggtataagaaatgtgtttgccacaagcgacatttcccaatccaagaatgccatgttcaaactgttgggagataaattctgccatttacatgagaattttgtacggcagggtaattattccttttctcttccctctgatttacaggaacactttattgaatatctcagtcgggtgaatgaggaatgttgtgacgaagtggataacaagatgcaaggagtagtcagacggatgggactgattgcttatcgtataatgatggtgttgaccgttgtccgacatttggataatgtgattcacaaatcttcttctgacgagactgtacaattggtttgccatgagtttgactattccgtagccatgagtatttgcgacaccctgctttatcatgccgtattcatttatctgaatttgtcaggaaatcagtctaaacgattcaataccgtttcgcaagagacaggcgtttatgcacgaaggaacaccctttataatatgttgcctgacactttcacaaagaaagattatgatgcggcggttttaactttgggcgagaatggaagtacggcaaacaagtggatagaagcctttatcaaagatggcaaactaagccgaatagaacaagggaaatataggaagattttttgagtggcaagtttgtgttttagtgtcactaaaacctatgcggcaagcggatagaacagccactctcaaaaaatcaatttatgaacataaaagtttagataagtatgaaggataagaaacttggtggtcgccctaagttggcgagttatcagaaacgcacgaaatgttttcgggtaatgtttaccgagaacgactacatttatatccaatccaaagcggagcaggctggattgtctgtcaatgaattttgccatcaggctgcaatggattgtcaagtctgtcaacgcatcagtcctgaaatggtatcggctattcgtgacctttccggtatcgccaataatgtcaatcagattgcccaccagatgcacacttatggtttggaagctgtcaagcaacaatgcttctcaatcatatcagaagtcaatagaatcatcacccaagtaaagaacaactgccatgatagcaaagattaaaacaagaaccgattttggaggaatagtgaattacgccaatgaccaaaagaacaagaaaaagagtgccacacttttggcacacgaaggagtctgcaccattagtaataaagccatcgctgatttttttcagatacaagcatccatgcgcccgaaagtaaaaagtccggtgaaacacgtatcacttgctttttcttcgcaagacattagccgttttcccgataatgaagaaggagatgcgctgatggtggagattgccaagaaatggatggaacaaatggggattcgtaatactcaatatatcatagcccggcatcacgacacgaaacatcctcattgccatttggtattcaatcggatagacaatgaaggcaatcttatttctgacagcaatgaaagaatacgcaatgcaaaagtttgtcgtgctttgactaaagagtatggattttactttgcccctaaaaatagtaaagccagaaataaaagtcgtttgcgtcctcaccaattacggaagtataatcttcgttcttcagttcttgatgcgcaggtaaattctcgttcttggaatgactttattagtacgctcaaaggtcagggcatagatatgcgttttaatcatgctgagaactctgataaaattcgtggtatatccttttgtatggatgaatttagcattgctggttctaaacttgaccgtgatttgagcttcaacaacctttgcactatgttgggtgatgtagctgcggaactgattattcaaccccatcaagtcataactcccggtggaggtggaggaaccaacaatgaacaaggcgggcgggatgataaagacaaggataaccaaagaagcgaacctttttataaaccttcaaaacgtagaagataatgaaagaagatgtaatagctgcaaatcttgcaaatttgcgccaaagtatcagtgaactgaaagagtgtattgaaaaacagaatgtcactgtttctaaatcggaacaatctgtaaaagtggaatttgatgaaaagaccatttatactggaattgccaaaagtttctgtacttgctggaatgaagccttgtctgtgatcaagaaacatatctggcaacagcagcctaacacattgccgttttcgctatggtttccgaaactcattgatttattcaagcagaagtccaaacttcttgaatatctttatcggcacgtttgcgattacaatcagaatcgtataactatcgaaactaatacccgatgtatattgaaacggcaggatgagatattagcaaaaatcaatgaattgaaaagccctgtaaccgttattccacctaatatcagtgggttgtttatatatggctatcatattaagctacgatatgtcatggtcttcattgtcgttattatgatatgggccgttgctgtttctgttagtagtatgaagtataaggaagagagctttgcgtattattctatgtatagggcagtgaaggaacagaatcagaacttgatagaaaagcagatagcaataaaaggggaaaattagtatatgcttctacgtatatactgtttgctccaatttatccctttacattttaatcaattgtgaaggaattttttatattggtgtatgagattaaattatgattaaactataatatgaaagtaattgattttagccaaacaaattcgattctaaaccagtacatatccgaaatcagaaatgtagaagttcagaatgaccgcctacgtttccgccgtaacattgaacggatcggagaaatcatggcttacgaaatgagcaaagagttccgatactcagtaaaaaacatccggacaccactgggcattgctcccgtcagcacaccggacaaccagcttgtcatcagcaccattctccgcgccggccttccttttcaccaaggcttcctaagctatttcgacggagcagaaaatgcatttgtgtccgcctatcgaaaatataaagataccctgaaatttgatatacatatagaatatatcgcatctccgcgtattgacgacaaaacgctgattatcaccgatccgatgctggctacaggcggcagtatggaactgagttatcaggccatgcttaccaaaggccatcccgccgaaattcacgtagcttcgatcattgccagccaacatgcaatcgatcatatcaagagcgtatttcccgaagacaaaacaaccatttggtgtgctgccatcgatcctgaaatcaatgaacattcctatattgtaccggggctgggcgacgcaggcgatctggcttatggagaaaaagagtaatatcgattaaagattccttcgatattgctgcggcgacatccccatttgcttcttgaagaatgtgccaaaataagaagcattggggaagccgaattcattggaaatctcctgaatatttttttgcgtattcttcaacaaagagatacacttacggataatcgccttgaatacaagttcctgcaccgtatacccacagatgcttttggaaagagccgaaaggtatttcggagacaaacagagtttatccgcatagaattccacactcctttcctgcatataatattgctctatcaactggatgagacggacaaatatctcatttttccgcccgcccgtttcctgtccggcactaatcaatttacggttatagaccgaacaaatacgataggtcagtgccagcagaaggagtttctgctcataaaggctaaacacactctcctccatttccagcacactgtctatcaaagacatatacttcataatctcatcttcctcgccggtattccatacacaagagagttccggagtaagtttcgaatacatatacatggaaaccacggagttgccgataatgtcacgtatcggttctatctgataggcaagaataagaatttccacatcttcggtctcctgaagcacttgaacccaagattcctcatgaataaacaaggtctcacccgccttggcagaagcgcacttattatcaagagaaaactggaaactaccttgccggcagacaatcaaaccaagcccctgcatcagaaaaggttcttttaaagaagatggaaaacaactgagcacacctcccgaactgcatatattcttcccgcttttcagatcgcggtcaagctgtaataaacgttcctgctgagtatccataacactgactcactgataaattactattgaaaaacgatactaagttagcaattttcgtttgggataaggcactacgagcacaaaaatcatacaaataacgcctgcataaatagtccaccctgccatttctttcacagcagagagcgtagcctgcacctgtatccgccccttgacggacatggcagccatgttatgcgcttccgtttcactctttccctgatattgcattccctgcacggtattggtatacgaagcagaagcttcggggtttaccagatcaacattttgtgcataacgggtaatataatgttgctggcgctcctgcagtacatttgaataaatagcccctccgatacccggtcccagtaccatacggacggtaagcatgatgcaaatccaggtcgaaagatatttgaaaggcatccgctgattggcatatgctgccgtcaatgcatataaaatcatcattccgatggtacgaataattacgggatacttcattcgttcgtaaagtccggctgtctgcacttcgaagtacatgaatcctgccgacaatgccagaaagaaaaagccaagagcaaaaagatatttcagatgcacccctttagaccccaatacaatggaaatcaaggcaccgataaaataaccgaccatacaccagtttgccagcgatgcattctgcaaattatccaggtgcatcccgactcctgcatacacattgacaaacattgcgctggaattgataatcatcagcaataaataaagcaaagcccccatacgaatggtacgcagcctcaacgcccccaaaataaagtaggaagaccgccgggtaacatccatataaagaaaaatcccggcaaaaaggatactgatcgccgttgcccagcaaatagatggatcatcataccaatccagcaccttgccataaaccagcacataagtgatgcacgtcaatgatatgcaaaatgcggtcacattgccgaatttgcggaagttgatagggaaacgtccggcaaaaccatgattaggcatcgtaatgaacagtatcagaatggacagcagcagaatacccatcataaaataatatacatatttccattcgtattcgaaagccagccaagccgttagcgccgtacccatttgccccaggatcataaaaaacagataaactaccggctggctgatacatttttcgatatccagtttattccatcccgtcgcgtctttcggttccatgccgggagtaatattacgcgttgcctccatgccaaaagcatatttgatcagcgtaaacagattgaccatcatcagtaccatacgcaggaaccctgtcagcaggctgcagagtgccagcaaaaagatactgtcggttttggcacatacatagctgaatacatacatcagtgcaaaacctgcgatacacatcagtttctcccgtcgtatacaaactagttcatacaagaagggagcaaatgccgccataccgatggaagtcacaaaattggcaaactgaatatgctcggaaataatacccaagccgctcatcatctcggtactgttcacggagtataccccgcccaccgaaagaatcggcaggaaaaagaacagcagaataataatacctatcggtttgggcacccaattgtaaaaaggataatttctaggacacgaaggcatggctatcagagtttagcttttactactaccatcatacccgccgccagcttatcattatcttccttcgataaatccgtaaaatcaatacggacagggatacgctgctgtattttcacaaagtttccggcagaattgtcagtcggcaccaacgaatatttagaacctgtcgctccggaaatagcagtcactttgcctgtaaactctttcttactgatagcatctaccgtgatagccacctcctgcccgatgcggagattctctatctgcgtttctttataattagcaataatccatttttgtgtatcgggcagaatatatgtaatgcattgccctgctgtaatgaactgcccttcttccagagaacgtctgcctaacttgccatcgcaaggagccagtacaaccgtatacgaaagattcagccgtgccatttcaagcgcagccgtagcacgctggatggcagcttccgtattctcacgacggtgagatacttcattcactcccgaaagagccgcctcccgctggcgcctggttgcttccagcttcttaaaggtagcttcatactctgttgtaatctgttccaactggataggtgtcgccgcatttcgtttgaccaaattttcataccgctgacggtctttctccagttttgctagccggatttctatttcagctatagacgcatcatacacagatgcagtcgtttgtgtagtctgcaaggtagcatttatcacagtggcgcctgcctgcgcatccttcaatgcagcctcagcttccatcacccggattttatattcgcggtcgtccagcaccagcaaggtatcacctttacgtacctgctgatgttccgtaaaataaatcttattaatatagcccgatgcacgcagattgacaggtgacacatattgctctatctgcgcatcattgctggtttccgtctgcttatagcccagaaagagaaaaacaatttcaattactccccaaacaatcacagcaactccaaacagacttactataatctgccagcggcgtaattttctcattttcttagctttctcctgatgcgtactggagattgtattattgtccattgtttccatatgaatgattcaattagttatctgttatttgaacaaggatgagatctgtccggttagtttcagtaacatcaggttggtcacccgataattataatgtgcactaatgtagttgttctgtgcctcgctcatccgcatttcatcctgcagaacttcagtcattgaagtgattccttcccgatagcggtcggtagtaaccgtatacacttcttcggcaagcagataattgtctttctgttttttaaagttccgctggttattcatcaagtcatttacagcattcaaatactgtgtttgcagattcttccgtgtatccaaccgtgaaagtttcatggtttcgatatcgatcattgctttccggatcttatacttcttatccaaaccatcaaaaataggaatacgcaaagtcagtcccaccccataagaacggaaccaatgattggacggaccggaatgaaaccaatgataagcctcatcagtataagcggcaaacctccagtttcccgtcagattgagagaaggaatatagccattacttatcaatcgtttctgccgctctgccagctgcacctgtgattgaagcaactgaagctcatagaggttttccgacaacccggtcaaagcaaccgtagcgatactatccgtattgaccggcaacaggccgatttctttttctgccggataatccatgatgtacttcagcatattaagctgctgcgtcatcatcgcctgcgcattgtcatactgtactttcagattttccagattgatattcacccgcttcaagtcaacttccattgccattccattatcaaagaaagcctgtgtgatatctctcagttcttccaatcgggtgatattggcttttatcaatgcaatctgttccgcagtaacctgtcccagatagtacattttactgatctgcaagatcaaatcttcccgtgccttttcatacgaaagccggctcatctcatccacaatctctgctatggaaatcgaagtatagagagtctgattataaagtggcatctgcaattctatcccggcattggcactatattgcaacgttcgggtaatattataaggtactccataggaagaaccgtcagttactgagacaggcggatcgatattatcattaaagttggcaaagccattgatttgcggcaacagcttcacccgattctccgaaatgccatacttacttttctgcatcgcttttcgttttccctgtaaagagagattgttctcaatccctatacgaaggcagttctccagagtcagaatattctgtgcgcctccatgaatggcaaggaggcaaaaaaaggtaaaaatgaacaatagtcttttcataataatcgctctatattcaggcacaaatttaatgggttgcgacaaaatgggactatccatatatcgactgtttatgttcatattttcctttttcagtcctgatatccaccttaattattataatatcactatatttaatagacaaatcttcgccctttgtcgatttccttttcttctgtttaaagaaccacttaactttggaatataaaatcaattaacagcaaaacagcgtttgtttttcataattttttagtgaatgcataagcggctctcttcgggatgaagagagccgcttaaggtatatagagtacaatatagtacaagatcagaaaaaagtttaagagttctcagcctccttttttttcggagttattaacttcttcttgctgaaccaaatcagaatcatcaccccgatcagcaataaagccagtgacgcataagctatgctttccgtaacatgcaagctctgcgggtcaaaccacatctcaatcgtatgctggcctgcgggaacattcatcacacgcaagatatagtcagcacgggcaatgtccaccggctgtccgtcaatcttggcctgccagcccggataataaatctcagagaaaacagccactccatctttagcagaagaagtttcatataccaggcgattcggttcatagctggtcagacgaatggtagataaggagtctttgtaacctttcgtcacacccttcaactgatctttaaatttcgcatcaaccactgctgtttccgttggaagaatatcattcagcgcatcaatctcttcatttgcattattgacatactgcaccttatccacaaaccaagcgttaccatacgcataagggttttcaacaggaaccgtctgtccttgctgtccggcagggaaaataaagtacttcgtattcagcatattcagcacacggaatttggaagcgtccacactatccatcgcaccgcctgcgccggcaacttcctgataggcatccttcatttccggagttatatgatgatcgatcatttcctgataacgacgcaacttggccgcatgataaccacccacactcttatgccaatatgaggtattattttcattgaaagtattaccgggaaatcctacgaaattcaacaccctataattcaaagccgtatcctgaagaattatctcatccgtctgagttttaacgaatgctcctgtctggtttgacttcgatacaaattgttcatcattcaaatagcgcttattgacagtccacatatcaatcagacacagaagcacgatacctgtcatagtaaaagaagccttcaactttttctgctgataaaggaataataagaagcatcctactactataataaagaaactgcgccatgcatccgaagtcagcattgccttgcgcatttcggccagattcgtaatgatcggagataaatactcggcaggcagtccttgctgcagagctgccatctcttgtgccggaatataactagagaagaaaactcccggggcaacagccagaatcagtgaaacaccggctgttaataccaaagtgataattactcctgtccgattttctttcaactttaatatttccggtttagccagcacttcttttaaggcaaagaccgctaataaaggtatcgtaaattcagctataactaggatagaagatacggcacggaacttgttatacatcggtacataatcgataaaaaagtccgtaagtcccataaaattctttccccacgaaagtagaatagagaagatagtagctcccagtaaagcccatttcagcggtcctttaacaataaagcaccccaatataaacagaaataaaacaaaagctcccacatagaccggtccggaagtcatgggctgatcgccaaaatactgtgtcagctgcgaatagatgttactatacatcggattcgcctttgccatggcagtctcattcttggataaaggaaccgatgcccctccctttacattcggaaccagcaaagtaagcgtttcaccaattccataactccagttcgttatatagttacggtccagtccgctgctggtctgattggcagcaggtccttcctgtttcagttcactctttccgcgcatagtctccttactatactcataagtatggtatagattggagaggttcgcacacactcctatcatcgcagccaatgccagaacggcacttgccttgaaaaaatgcggcaactccttcttcttataagcatcttcaaagtaagctcctacaaaaaacaggatgacaaacatgaagtagtagctcatctgaatatggttcgactgaatctgaagcgcgataaacaaagcagtcacaatccctcccaacagatatttcttccgataagccagtacaataccggcaatcgtaggcggaatataagccaatgtgacaaatttccagatatgccctgccgatatcaaaataaagaaataggaggagaaagcccagataatcccccctaaagcagataaccagacagacaacccgaatgcccgcaaaaggatataaaacccgagcatcatgatgaaggtcagcaccacataagatggaagatacaagtgatagatgttttctatccacttcagcggtttggtagaatcataactcggagacatctgataggtaggcataccaccaaaaagagagtttgtccagcgggtacgttctcctgtacgttcaagatattcctgagcttcttgaccggctcccactccagccaccgtatcgtgctgaaacagaatacgactttcgatatcagccggaaaaaaataagcaaaagaaaggatgataaaagctaaaatagcaattaagtcgggaaggaacttcttcataaaattgacaattgacaattgacaattgacaattgatggtcaacaataacagcccggcagatcactcgttccatatagctgttcattgtcatttgtcaactgtcaattgtcaattaaattagtatctataatgttcagccttataaggtccgtctaccgatacaccgatataagcggcctgttccggagtcagcttcgtcagtttcaccccgatcttttcgagatgcaggcgagccacttcttcatccaggtgcttcggcaagcggtatacatttacttcgtatttcttgttgaacaactcgatctgggccagcgtctgattggtaaatgagttactcatcacgaatgacggatggcctgtcgcacatcccaaattcaccagacgaccgtcagccagcaaaagaatgctgtgaccatccgggaaataatagcggtctacctgcggcttgatgtttacacatttgatgcccgaataatgtttcaacgcatccacctggatttcattatcaaagtggccgatgttacatacgatcgcctgatctttcattttctccatgtggtcaatgcgaatgatatcgatattccccgtagtagtcacgaagatattaccttcggtgcaggcatcttccatcgttacgacttcgaaaccttccatagcagcctgcaacgcacaaatcggatcgacttccgtcacaagcacacgcgcaccataagagcgcattgaatgcgaacatcccttgcccacatcaccgtaaccacataccaccactaccttaccggcaatcatcacatcggtcgctctcttgataccgtcagccagtgactcacgacatccgtagagattatcaaacttagacttggtaaccgaatcgttcacattaaatgccgggaacagcaatttgccttcttcctgcatctgatacaaacggtgtacaccggtcgttgtctcttccgatacgccgcgcatttcctcagccacacgatgccagcgagtcttatcctcagccaatacttttttcagaatggcattcagttcgatttcatcctccgcatgcacttccttgtccaatacggcagcatcattctcggcatcataaccgacatgaatcatcattgtagcgtcaccaccatcgtctacaatcacattcggaccttttccgccggggaagttcaatgcctgcaatgtgcaccaccagtagtcggcaagattctcgcctttccatgcaaataccgcaacaccggaagcagcaatcgcagcagcagcatgatcctgcgttgaatatatattacaagagcaccagcggacttcagctcccaatgcaaccagtgtttcaatcagtacggcggtctggatggtcatatgtaatgatcccatgatacgggcaccttttaacggtttggattctccatacttttcgcgtagagccatcaggccgggcatttctttttctgccaaatcgatttccttgcgtccgaaatcagcaagtgtaatatctgccactttataaggcagagtagagaataattctgtagacatattgtaaatcatttaaaatgtaattgatgcaaagatagaacattctgattagtagggcaaaagctatccttcttttttataaaaaaaacacttacaccgggctcccattggctaaccaatataatatgcatatataaaatgcggtgaacatcttactaatgtccaccgcattttatatatgacaatcaacgttacttcttttcagctttcgttatcggcgcgctcagcatttccttatacttcgcaggatcattcaatacctttattgcttcctgcaaatcatcatcatccttcagttgctcgataataccacctctctggaaataataacgcttgataatttcattagcaatcattctcttgatatccttagagaaataatccaggtcacggtcaagattatgattcaacttcttttccagtgccttgaactcttcggcagcatctgtcatatagccttcaaattcagcagcctctttcagtgttttcagaatcttctcactctgctggtcatatttgaaatcggccttcttcaccagttccttgaaatcattgtaatcagcatccgtcactacaaacttttcaggagcagctacagtaggatgcttcaagcagtattgagttgcatagtcaaaaatcagattatcacgtacgagatagaacaagatattcgggagtttttcctgcttgacagtaatatcaggcattacaccacctccgtcacgtacttcacgtccggcagcagtatagaatacgttagtcagactgtcgggaatcgttcccacacttccatcttcgttccggtgcttatagtcgatcgcctgcacacaacgtccgcttgggatataatatttggaagtagtcactttcatcattcctccataaggtaaagaacggggaacctgtacaagtccctttccaaatgtacggttaccaacaataacggcacgatcaaggtcttgcaatgagcccgacaggatttctgaagcagaagccgtaccactgtttaccaatacggcaatcggaatatccagatccagcggttcacgcaaagtcttgtatgtgttgcttgcctgtttcgtctttcccttggtggttacgattacttttccacggggcaggaaataattggctatttccactgcttcatccaacagaccgccaccgttattacggaggtcgatgaccagagaagtagctccctgtttcttcagatccagcaatgcttttttgaaatccttggaagggttgccggagaatgtgctcaggctgatatatcccactttattatccatcacggtagcatatgggatggcaggggtctgaatagattcacgtacgatagtaaactccatcggggtttgtccgcctttctcattaggacgctccactttcagtttaaagctcgtacccgcctgtccgcgcaacatctggctgacttccgaattattctttccaaggagatcttttccgtctatttccatcaggatatctcccgccttcagtcccgctttggccgccggagttccctcgaacggttcggcaatcatggaacgtttcagcttcgtattataggtaataagagaaccgatacctccaaagcttcctttcaccatctgttccagttcgctttgatcttcctccgggtaatattctgtataaggatccagcgagaaaagcatattgtcgattccttcgcgaatggtcttgttcggatcaatggtatccacgtagaacatatccagttctttcacaatcgcattaaatgtatccagattcttggcaatctggaaattgcggtcgtctccactcttaaaactaaagaaagctacagtagctattacagccaccaaaacaagagctatccgcctattcagcaattttttcatatatctttcattaaaatgagacgtaaaagtaactcaaaccttggttattccgccagaaccttgttaatatttaacttaatttcatcccagcgctccggagagattgttgttccaatcacctgaataacatttcccgagagaatagaaccaatttttgcacatttttcgagcgagtatccgcacgtcagaccatacagaaatccggcagcgaaataatcgcctgcgccggtggtatccagaactttttctacaggaatagccgacactttaatttcttccgtacctttacggatataagatccgtttgctccaactttcacaatagcaatgctgcatttcttggctatcactctcagagcttcctccggttcttcgccggtaaatgctttcgcttcttcctcgtttgcaaaaacgatatccacatacttatttattaataaggagaaaaattccagatcattctccacgatattataacttgccatgtcgagacagatttgcaggccagcctctttagccagttcgatggcatgaagaatcatttcgtgatcctgaacaaggtatccttctataaataagtatgcatatcctttgaacatctccaatgtcagatcttcagctttcaaagaagcggccgctcccagataagtaccaaaagtacgctctccatcctgagaaataaaagtggatgccactcccgaaggaagctgttcggaggtcaataaattgtcttcaatattatttttctgcagatttttccgaaaaaaatcgccataatgatcatttcctacttttccgataaaacctgttccggcacccagacaagcgagtccaagtatggcatttcctgccgatccgcctgttgccagatgcgttttcatttgtgaaaattttgtgttaatctgctgtaacttagcgtcatcgatgagttgcatgcttcccttgggtaattccagttcatccaagagtgtatcgtctttcagggttgcaagtacgtctatcagggcgttgcccaatcctattattttgtccattctcaatattttttttgcaaagatattgcatatttcaaaaaaacctactacttttgcatcgcaattgagaaaaacattcttccttagctcagtcggttagagcatctgactgttaatcagagggtccttggttcaagtccaagaggaagagcaaaactgaaattcttgattgcaacattcttccttagctcagtcggttagagcatctgactgttaatcagagggtccttggttcaagtccaagaggaagagcaaaaagaggtgtatcgaaagatagacctcttttttgtttctgctcttctcccccctgcttcgaaaatagagggtcagtccgaaaaccgaaactctcatccccttcttttattcacaaaaacattcttgtcttttgatggtctataaaactttaaagattcaaaggttaacaataaactttccatctgaataaagtaagttctttgggtacatgaattaattcgtccggctataggcattctttcgtccgcctatagccggacgaaagtttgcctataggcaacgttgcgtttgcccataggcggacgaattaatttatgaagagaaagtacttatttgtagaacagcaacaacataatgtaagcattggcattcattatagtttatatattaaagagagtcttcgggaagacgacaagctaccctattctgccatagccaacgtcaacacactaatccgtactccttcaatctctgccagccgagaagcgcacgctacggtagtcgctccagtcgtcaacacatcatctactattaatatatgctttcctgccaaatactccgaacgatgcaattcgaagattccatctacattctcccaacgttctaaagctgacttttgtgtttgcgtttccgtattcttccggcgtatgattgcttcggtatccaccggaatacctgttacggccataatcccgcgcgatatccattcactttgattgtagccacgtatctgctgtttcttcttatgcaaagggatgggaatgattacatcaactccatgaaagaagtcggaagcctgcaattcggatgccatatatcgtcccataatagcaccaatttctttttgtcctccatatttgagttggtggagaacttgccgaaaatcacttcctttgcgataaaagaaaaaagaagtggcacgttccagaggaaacttaccccaaaagagtttttctaccggattgtctttccgaagatgataatcggtacgaggcaagtttatattgcacatggtgcaaatacactcttctcctttagccaacgatccgccacaaacgacgcagcaacggggaaaccaaagggacaaaaaagaataaagccaatcttttataagtaatgtgtgtttcatagtagtagctatttatacaatcgcagcagtcttacatatccaacggaggaacttctgctaagagtttcaaaaataaaggatgcaggtatccattggttgcaataatatgatgaccttctataaaatggtcgtcaccatagaaattagtcacgcgaccgcctgcttccaacacaatcagggcagccgccgaataatcccacttaccgataaacgcttcggcccatgcatcaaaacgaccattagctatataacagattgcagccgcagccgaaccgttcatgcgaatgcctcccacggctccataaaggttatcaatcagatggagagccgtcggtttatactgatcataattataaggtaattcagtaaacacaaatgcattcttgatatcccggacatccgaaacatgaatttcctcaccattcatgaaagcctttcctcctttccaggcatagaaacattcattccggcagacttcatacacaactcccaaaagcaattcggtacgactgcgcagagcgatgcatacacaataaggagcctcatcatgaatataattcgtagttccgtccaacggatcaatgacccagcagtaaggttcgtcctgataagtagcagagccttcttccgtaataaatcctgcttcgggcaacaaggcagaaagcgcttttaccaaccgtacttcagactctttatccacatacgacacataatcatgcgcatgtttttccataacacgctcacgacggaagtttttccgctcttctttcagaaaatgcccagcttcggtagctatgcggcatacttcaactgtaagttgctttaaatccaacatttcatctttattattaaaaagtacatcgaaggtatagcttttcttatgaaaaaccatccaaaatgagtattattttcagatagactatcaaacattcaattttcaaggcagaaaaacattcaatcacattataatatatttttctgatctgaggaaatgagaattccctgcaattttcagaacaggcccggcctcttcccacaaatatacgcaacaaagagctacagaaaacacaaagtgacagaatgccagatttgctttttacataaaaattcccgaatattgcaatctaatactaatgcaaagagttccctatgaaaagagtagattccgttatatccctgatatactcgttatctaaatcagaaaagaagcacttctccctacaggttatcaaggacaaggaggaaaaagactatctggtgatttatgatattatcataaagagtaaacaaccgaatggaaatactgtaaaagaggaattttacagacgcaagcccaatggctcatttgaagtatccattcaatacttatatgaaaagctgacggatacgttactcaccctgcgtaaaaagaaagatatctattacgatctgctgaataatttgtgcaaagcccgaatgctttatgaacgttctctgtttgaagagtgtttcgaaatactatccaatacaatagaacaagcacaattctatgagaacaacgaaattctgacgatagctttgaagctggaactggaatatctgctccgtctgaactttcccaacatgacagaacaggagctttttcacaaacacttcatccaaaatgaagctttgaaaaagattcggaaaatcacagagcaatcttcattacacaacttattgaaatatcgtttatctcatattggctccatcagaacagtaaagcaaaaacaggatatgaatgaccttatggtcaacgaactttatatagccgcttcttcagactccgaaggtaattttgaattaacacgaaaccataaactttttcaggctaattacctgatgggagcaggcgattacagagctgccttaaattcatacaaagaactagactcattatttgagcagaatcagcagttctggtcaaatcctcctatatactatttatctgtactcgaaggagtactcggtagcctgcggtctgtgagcaactatgacgaaatcccctacttccttgataaattaagaaagcttatatcagacagcacttcgctcgaatttaaagtaaatgcaacttgccttctcttccaatacgaactatttccctatctggataaaggagatttttcgaaatgtacccaacttatggcagactaccaggaaatactttatgataaagaagcctggttaggccctattcgaaaaagtgaattattgctttacaccacactcgtacacattggtaaccaagaatataaaactgctaaaaagtatatcagcaacgctatcatagaccataacataaagtatctgcctttaatgagaactattcgtctggtccgcctcatcgtcttttatgaagtgcaggagcatgagctaatccagtatgaatcccgttccatcacccgaagtctatcttcgcccaaagagcagacttttaaaacagaacgtatcattttatggtttctgaataaaagaaatattcccatcctgaaaaaagacagagaagcattttgggaaaagttgtctcctgagattcatgaattatataataataaatatgaaagtcagcttttacgcctctttgactttacggcgtggatggaatccaaaattcggaaagaaaaactgtctgaagtcctcagagcacgtgctagcgcaaaagaatgttaaagagtaaggtgtttgattcgtatttcagacgataaaaacactcttttcaaatctccattttctctttgtaattatataaattcgcttcacattacctctatattccattgtttgtttatagataaagaatgaccgcataataaattcctatcgcaataaagaggatggcaacaattttgcgaaaccatttttcaaagatttgtactctgttataaaacttgcctaatccggcaacactgtacgccaatatccaagcaacaaggattacaggtagtcccgtagcaatagcataaattacaggtaaaagatacccgcctgtttctgctgctgccaagggcataagcataccgaaatagaaaaccccacttgtaggacaaaaggcgagagcaaataaaactcctaataacatagctccccaactgccttttgttttcttctttagaccctctccgccaatattgacttttggtatattcagttttataatatcaagcatgaatattccgataataattaaaaccggagcaatcaacatttcaccgtatttactgactgccttttgaaccatgaacatacttgcaccctcacgaagaataggaataagaatgaaaccaagtgctgtataagttactattctgccgaatgtataaagcaatccgtttataaatatacggtgatggttctctatatccttactgataaatcctattgccgttatattagtagccaaaggacaagggctaactgccgttaaagtccctaagataaaggctgtaatagcaggaatagaactattgtctaatagtgattgaagaaagtccatcttacaatgtttttagtaattcgtcaatcttgttttttattccctctttaaatttatccggttcatttcttgcattggagaaactaaactccgtcatgttatttacattctctttactgtctttccagccattcacaaacaaagacgaccatgtaacttcgtatttatctgcaatttgctcattttcctttttggatatatctatcaccttgaagatgattttaccgtccgcctgttctttggaataaaggctatctaaaagagctaccgtattggcttctattgcccggcaggttatgcaacgttgcgcaccgtgaaaatatagaacttcaacacggttagtttgattttcttttgctatgctggtttctgttttattctttgaaccattaccacaggaaattaaaacgattgttgcaatcagtagataaaataacttcttcatagtaaataatttatttagttatcaattctttcacttctgataaggataatctttttccggcagatatgactttaccatcaataaccaaagccgggagacttaaaatattatactccatgatttttaataaatcttcttccttaattagagttgcatcgcagcccagttctgaaatagcttgttttgtggtttcgtacaatgccttacagcttgaacacccagttcctaatactttgatttccattttctattcaattataaagttaatataccaatcgtaattcgtagaactacgaacattattctcaaaaaaaggtgctgttatccacagcacgatgtacccgtacatttacaatcacccaaaaatgcagcaaataatttacgggcaagttcccaattctctcggttgatacaataccgaacttttggtgtttctatttccccctgaattaaccctgcatctttcagttcttttaaatgctgcgaaacggttgctttagcaatgggtagtacttcgtgaatatctccgaagaaacaactttcttgtttagctaagaaactaagaattgccattcgtgccgggtgacccatagctttagcaaaacgagccatctgttcctgttcctctgtgtactgcttagttttcacttttatatctcctttcttgtttgttgttcgcaaaactacgaactatttttaaattggcaaaataaaacagatgatattttttagattaaacattttttaggtgcaaggtgcaagtatatatctatatatatagcttgcaccttgcacctacatggaaacatttatattcaggcatttgcgtaattcggaaaagagttgtatctttgaacccgtgagataggcagacaaacagcggacaaagccggacaaaagcgttaataaaaatcgttactgtttcgttacctatttgaaatattggaaaataaaagactgatttataggcggttgggcgtttgggttcagtaccctgtctctccgctgggaagcagcttttgggctgcttttttgtttttatggagggcgacgcctccgatgtcgtgaaacgaaaacgggagcgttttcttagtgtttattgagttttttgaaaggagagatgctcgagtggttgaagaggcacgcctggaaagcgtgtatacgccaaaagtgtatcgcgggttcgaatcccgctctctccgctgaatctgaaatttagtcaaaacttctcgttctttagccaaaagttcttttcataggtcaaagtgtctggtatttctagtactcttctcttgtatatcattctcttttctgtatatttgcgcccgatattttttttgagatatcacatttttgtaattctgaaaatagacttgatggataaaataaatgcggtaattactggggtcgggggatatgtgcccgattatgtgctgactaatgatgaaatttctaaaatggtggataccaccgacgaatggatcatggggcgtatcggcataaaagaacgacatatcttgaatgaagaggggcttggaacttcgtatatggcccgtaaggccgccaagcagttgatgcaacgcacaaagagtcgtcccgatgatatcgatctggtcattgtcgccactaccacttcggactatcgttttccttcaacggcatctatcttgtgcgaaaggctggggctgaagaatgctttcgctttcgatatgcaggcggtttgcagcggtttcctgtatgcgatggaaacgggagcgaattttatccgttcggggaaatataaaaagattattattgtaggtgctgataagatgtcatccgtaatcgattatacggaccgtgccacttgccctatctttggcgacggtgcggccgcttttatgctggaaccgactacggaagaggtcggcatcatggattcggtgttgagaacggatggtaaagggctgccttttctgcatataaaagcgggaggttccgtatgtcctccttcctattattcattggatcatcatctgcattatatttatcaggaaggccgcacggtgttcaagtatgccgtagcgaatatgtcggattcctgtgaagctattatcgccagaaaccatctgactaaggaagaggttgactgggtgattcctcatcaggctaaccagcgtatcattaccgctgtggcgcaacgactcgaagtaccgtccgagaaagtgatggtcaacatcgaacgttatggcaacaccagtgccggcacgcttccgctctgcatctgggattttgagaaaaaactgaagaaaggcgataatctgatatttaccgcattcggtgcgggatttgcctggggagcggtttatgtgaagtggggatatgaccccaaagaagatgcgtgacatatcggatacccgatacgtcacatcctcttttgaagggcgggggagacttattccagttcctcgataatcttctttacatccaccggttgcagtcgtccgtacaccttttcgccgatcatcactaccggagccagtccgcaggcgcctacgcagcgcaggcaatccagcgaatactttccgtcgggggtggtttctccgacttcgatgccgagtacccgcttgaactcttccagcaacttctccgaaccacgtacgtagcacgccgtgcccatgcagacggaaatcggatgctttcctttgggagtcatcgtaaagaaggtgtagaatgtcacaactccgtagactttcgacacggggattctgagtttggaggctatgatccgttgcatctcttcgggcagatagccgtgcagatgttgcgcttcatgcaaaatattgattaattcgcccgcattgttcccgtgcttgtcgcaaatcgtcttgacttgttccaccacatcgcaggctagtttgatatctgacataatagtacttgtttaaagttaatcaatcgatttgttgaaataatgcgtgtgcaagagcatttccgatttctcacccagcggtttgccgaggtattcttcatacagtttctgaatatacgggttgtcgtgagatttgcgcaaaggtttgttggcatcttcccggtaaagggcgttggcacgggcgtagagaacgtccgagttgccgtgatgcaacggttgcccgccacctccgatgcagccgccggggcatgccatgatttcgatgacatgatattcattatgtccgtttcgtatatcttctagtaagtgccttgcgttgcctagtccgtgtgcgatgcctactttcagttcaaatccgttcaggtcgatggtggcgcgccggacaccgctcagtccgcgtacctgttcaaagttgacattcttcagcggctgtccggtgtagatttcataaacggagcgcagggcggcttccatgacaccacccgtcgtaccgaagatgacaccggcgccggtcgattctcccatagggttgtcgaacgggctgtccagcacgagggtaaagccgatgttggctcgctttatcaggcgtgccagttcgcgggtggagatggagtaatcgacgtcggggacaccgtttactttgaactcgtcgcggtcacattcatatttcttggctaggcagggcatgatggagacgactaccagcttttcgcggggaattcccattttctctgcccagtaagacttggcgatggagccgaacatctgttgcggagaacgggcggtagaagggatatccagcatatccgggaagtggtgctcgaagaagtttacccaagccgggcagcaggaagtcaggatcggaagccggacggatttatctccgtccagatagcgtgtcagtcggttcaggatttcggaaccttcttccatgatggtgaggtcggcggcaaagtcggtatcgaatacatagtcgaaacccagttcgcggagggcgtaaaccatttttccggttaccagtgtgccgggaggcaagccgaattcttctcccagggcggcacgtacggcgggggcagtctggacaattacgatcttatcggggtcggccaaatcgtccagaaggcggttggtgtaatcccgttcggtcagtgcgcctaccggacatacggctacgcattgaccgcagtaggtacattcgctgtctttcatcattctgtcgaaggcaggggctatcgttgtgttgaatccgcggcggatggctcccagtgcgccgactgtctgtacatcgttgcagacgctttcgcatcggcggcagaagatacacttgtccatgttgcgcacaatggaggaggtcacttcccgtttgcggggagaaagttcgccgccgttgaacggcatttcacggatgttgaaacgcagtgccagtgtctggagttcacagttgccgcatttgggacaggtgagacagtcgttgggatgatcggacaggatcagttcggctaccactttccgggcgttcatcacgcgtagggtactggttttcaccaccatcccttccgtgcaacgggtagcgcaggcgggagccagattgcggcgtcctgccacttcgactacacagatgcggcaggaagcgggattgttcttgatacaggttcctttcaggtcgatgtgacacagcgtaggtatgttgatgccgattttgcaggcggcttcgaggatcgtgcttccttcgggtacggtgataaagtgaccgtctatctggagggtaatttgtttttcttccatagcagtagattttaacagacaagaatagctttgaatttacagcgtgccatacacatgccgcacttgatacatttctcggggtggatgacatgaggtttgcgtaccaagccgctgatggcatccgccggacaattcttggcacacaggtggcaaccgatacaaagttccggattaatggtataggtcagcagggacttgcattgtttggcgcggcaggtcttgtctctgacatgttccagatattcgtcacggaagttgtcgagggtagacaacaccggattcggggacgtctgtcccagtccgcagagtgccgtgtcttttatcacccgtccgagggtggcaagcgtgtccaggtctttttccgtgccccgtccttccgttatcttgttcagcagttccagcaggcgtttgttgccgatacggcatggggtacatttaccgcaggattcttcgacggtaaagtcgagatagaaacgggcgacggataccatacagtcatcttcgtccatcacgatcatgcctcccgatcccatcatggaaccggctgccagcaggttgtcgaagtcaatgggagtatccagatgtttctccgtcagacagccccctgacggaccgcctgtctgtacggctttgaatttctttcctcccttgatgcctccgccgatttcgtagattacttcccgcagggtagttcccatcggtacttcgatcagtccgacattgttgatctttccggcaagagcgaagactttggtgcctttggagcgttctgttccgatggaggcgaaccattcggcgcctttggtcaggataatgggaatattggcgagggtttccacattgttcacattggtcggtttgcccagataaccggattcggcggggaaaggaggtttcagggtcggctctccccgttttccttccatcgagtggatgagggcggtttcctcgccgcagacgaatgcgcctgctccgtaacggatctctatgtcgaagctgaaatctgtccccaggatgtggtcccccagtaatccgtattcacgggcttgctcaatcgcttttttgaggcggttgatggccagcggatattcggcgcggatgtagaccagtcctttggaggaaccgatggagtaaccgcagatgcacatcgcttctacaatagagtgcgggtcgccttccatgatggagcggtccatgaaggcgccggggtcgccttcgtcggcgttgcagacaacgtactttacgttcgatacctgcttactggcaaattcccatttcaagccggtggggaaaccgccaccgccacgtccccgcagtccggagcgtttgatgatgtcgatgacgtcggcaggctgtttgttgagaaggcagtcggccagtgcgaagtatccttcacgggcgatgtattcttctatattttcggagtcgatgaatccgcagttgcgcaaggcgatgcggagttgtttccggtagaagtccatgtgtttggagtcactgacagtttgttcggtcttcgggtctatgtagagcagccgttcgattcttcgtcctccgatgatgtgttcgctgatgatttcctccgcatcttcgggagtgacttgggtatagaacgtattgtcaggaatgatctttacgatggggcccttttcgcagaagccgaagcagcctactgtgatgacgtctactttgtcggtaatcccgtttctttcgatggctttttgaagattttcagtgatgccctgactggaagaggctttacaaccggtacctccgcaaataagaatctggaggtgtgttgttccggacgccagcccgcaacatttttcggaaaccttttcattactttcttcgcgcaatgaaagatggtgctccgctctcttcctgattatttgcaaatcatggatagatagtattttcataagtatcagaattgttagatttctgcaaatataattctttgttcggaattagcgctttgtttagagaaaataaatattcttctttggtgtcggcttgcggaagtatggtatgaaatctttatttttaacacttttaatagacggtgttaactataatagtagcataaaaaaattatcttcgcatcgaaaaagggcgaatacccatatgaatccaacaatagttggggagattcgcaagaacattgtggagtgacttatggggacctgccggtactgtatctgaatgggaaaatgctccttgtatgagttttatatagcttgatggcaaggatgtacagcaagagttccggcggggacggggaaacgtaagttgcctccctgatacaaagggaaaaaaggggattgtgatagcctgtaagtggtatgcttgcaggctatctttttgagtatacttgaatgtccggagtatgaaggcagtccgtaccggtgaaaataaaaacgggttttctgataccagttaggtaaattattccttattttcgtattaaatacgtagcaaacgtaaataagaaatggaagtatgagacgaattttgttaggattgtgtgtgctttttttcctgaatgcgcacgggcaggagattccgttgccggagaagatgccgcaggatcatccgagagtactgactaccccggaaggaaaaaaagaaacatggaagttgatcaagaaggaagcatgggcacaagatgtctttaacaagctgaaagaacggacggaagtatatacgcgacgtacggaaagtcagccggactggttattatcccgtttggccatgtactggaagtcgcatgcaacggaagtgtacgtgaaaggtgaggtgttcgaccatgccggaggcgcgaaggcacctgctccgacggttcgctataccggaacacgagggacggccgctacgcacggtcgacctaagctggaagatgtagtaccttatgacgatagtgcggaaggaaacgtgactttctgcaacaatgccctgaaaggtcgtccgctggagagtgtgcatccgtccaagaccggacgcaatattgaaagtctgaactgtgagattctgggaattgcccgtgacgccgctttcctctattggatgacgggagaggaaaagtatgcccgactggctgccggcgttttcgatacttatatgacgggaatttattacagaaatgttcctgttgacctgaatcacgggcatcagcagacactggtggggctgacttcttttgaagtgatccatgaggatgctttgcatatcgttgtccctttgtatgacttcctctatcattatctgcaatccaactatccggataagatgatgatttatgccggcgcattgaagaaatgggcggataatatcatcgccaacggagtcccccataataactgggatttattgcaggcacgatatatcatgaacgtgggactggtgctggaagataataaagaatatgcggacgggaaaggacgcgaatactatattgactacgttatgaaccgttcgagcatccgccagtggagtctgaccaagctggccgattacggctttgactccgaaacgggtatatgggcggaatgtccgggatacagcagtgtagtcatcaatgactacgcgaacttcacccatcagtttgaccacaatctgcaatatgacttggtaaaggcaatgcctgtgctggcaaaagcagtagcgactactccgcagtatctttttccgaaccggatgatctgtggtttcggagatacgcatccaagttacttaagtacgaacttctttatccggatgatacagaatgcgcaggcaaacggaaagaaagagcaggaacgttacttcaccgctttgctgaaatgtctgaatccggaggaaggtagcgaaaaaagtggcaagaagaatgtacgggcctctgtcaactccttctttgaggacaagccgttagtgttggacccgaaggtggaggcggggaaaatcgaggattatgtatctcctctgttctatgcccccaacgtatcgtggctggtacagcgcaacgggatgcatccgcgcaacagtctgatgatttctctcaatgctagtgaaggcaatcatatgcacgcgaatggtatttcgatggagctttatggaaaaggatatgtgctgggaccggatgcgggtatcggactttttctgtatagcggtctggactatgcggaatattactctcaattccccagtcataatacggtttgtgtagatggcatttccagttatccggtgatgaaaagtaatcattctttcgatttgctttcctgttttccggcttcggcggaaccgggtaaaggatttacttccgtcacctatagtcaggtagctttccgtgagccggagagcagggcggatcagactcgactgatgggcattgttactaccggtccggagacagggtattatgtggatgtattccgcagccggaaagaacggggaggcgataaaatgcacgattatttctaccataatctaggtcagacaatgacacttacggctgccgatggtacggacttgaatttgcagcctaccgaagagctagcttttgcaggtgcccatctttatgcttattcctacttatatgataagaaagtggctaccaccggtcaggatgtgaaagtgacttttaccatcgatatgaaggataaaggcggagatgatatttccatgaatctctggatgaaaggagaaccggaacgggaagtgttcaccgcactgtcaccgatgaccgaaggattgagccggactccccatatgccttataatataaaggaacagcctacgctcaccttcgttgcccggcagcatggagaagcatggaatcgtccttttgttgctgtttatgaaccaagtacgcagaaagagccttcggctattcagtcagtctcttactttgatgcggaagagcccggcttgaaagactttgccggtatctgtgtggaaagtaaaaacgggcgtactgaccatattttctctttgacggattcgtcgcagaccgcaacctatcagggaatgaaagtgaaagcggactatgccgtaatcagtaacgaatatgcgggaaaccggacgctgtttatagggaacggaacgcaactgattgcatccggtatcagtatccagacttcggaggctgctaatgtgctgctcgaaaagaagcagggaaaatggtatattctttcttctgccccctgtaagatggtgattgacggaaaagcggtgcaatctggaataaccaccgaattgacgttattggctgtacaataagaatcattgttagatgaataaacatatcattgttttaattgaacgattgttgttttgcgagttttcataaatatctttgatagagaataggtgaatcgtctttattgttcgtaatactataaaagaattttattcgataatatcatgaagaaatattggttcttattattagctgcattattaggtggtgcaacttgtatctttgctaaagacacacttgcaacttggaaggctcccgcaggagttgctttaaatagtgattttacggttaaggtccgtttgcaagatggagtctggcataccttatcttcttatctgattaaggtggatgaggtaagagatacacgacattatgtagaaaatgcttcgatggcaatttttgattttacaggaaaagtggaagtagccgtaacctataatttgggagaagtacagacggcaaaagtccgtcctctctcgtatgatatcccatttcagatcgatggtaatacagtaacttttacattagagcatcctcgaaatttgtcagtagaagtaaatggggatatttttcataattttcacttatttacaggatctccggaaagaacgattccggacaaagataatccggaagtaatttactttggtcctggaatacatacagttaaaaatggggaattgagagtgccatccggtaagactgtgtatctggcaggaggagctgttttaatggggcgtgtcctaatcgaaaacgtacatgatgtaaaattgctaggaagaggaattatcgatcattctataaaaggaggtattcgtattgcgaattcccgagatgtctatgtagaaggaattgttgctactcaatgtgcgacaggagggtcggaaaatgttactatccgtaatgtcaaaagtattagttattatgggtggggagatggcatgaatgtttttgcgagcaataacgtattatttgatggtgtcttctgccgtaactcagatgattgtacaactgtttatggcactcgtttgggatttgaaggaggttgtcggaatataacaatgcagaattccactctttgggcagatgtagcccatcctatttttattggaattcatggtaattctaaagctcccgaagttttggaagatctgaattatattaatattgatatattggatcatagagagaaacaagtcgattatcaaggatgtatggctattaatgcaggtgataacaatttaatacgcaatgttcattttgaggacatccgtgttgagaatttccgtcaggggcaacttgtcaatttacgtatcttttataatgaaaaatactgtactgctcccggaagaggaattgagaacgtattgtttaagaatatatcctataccggagagaatgcggaactttctattattgaaggatatgatgaaaaacgtaaggtaaagaacatacgttttgaaaatttgaaaataaatggaaaattgattgatgataatatgccggacaaacctcggtggtataagacttcagatatggcacgcatatatgtaggacctcatgtggaaaatattgtttttacaagtgatgtagctcagtcacaacgtcgttttgttcatccgggtattacttatacgcaaggtgacctcgatcgtatgaaagcaatggtagaagccagacaagaaccttattattctacctttttgaaattgaaggagtcttcttattcatcacttgatgcacctgtggtgaatcgtggagagcaaataaaggaagggcgatttaatgctacaatcggggtggatgggcgtcgtgctcatgatttagctcttctttggcacttgacaggagaagaagcctatgcacgtaaggctgtagaatatttgaatgcaaattcttattatactaatactagtagccgtggtacaggaccgttggataatgggaaaatttatttgttgattgatgcggctgaaatgatgagagattattctggatggacacggcaagatcagcaacgtttcaaagatatgctggtttatccggggtatagtaatacggaaaattattctgctaaatatgctaattatctggatgatacaaaaaatggagtaactttttattggaatatctataattttgatgcagcgcgtttcggtaatcaaggattgtttgcagcacgcagtatgatggcaatggctatctatcttgataatgagataatgtatgaccgtgcttatcgctatttactgggaatgaaacatcgtaaagatgatttgccatatccttcaggaccggctatttccagcgatcaacccattcatgtttctcctactatgattgattataaattgttacaacggaagaatgatattcaggattatggttatgacgaacagcttcaatattatatttatcctaatggtcagtgtcaggaatccagtcgtgatcagggacatgtattagccgggttgcacaattatgttgctattgcagaaatggcatggaatcagggggattctttatatagtagtttggacaatcgtttattgctcgggctagaatggagttatcgttataacctgtcaagtattcaatcttacaaaaaacaggaaacaccttgggagccaacaggattaacaaaggatatgaatgaagtcacatttgataacgggaaatatctccagataaaaagtcgtagcggacgttgggagtctgtgaatatctcctctcatggacggggagatgttgccgggacaggaggaaccagagaaatggcattggcacattatgcggtgcgtagtggattaccggctgaaaaatatacctggttacagcgttatcgtgattatatgatagaacgttatggatgtgagaattggggagtagccccgaattggttttatgagtggactggttgggggactttaactaagcgactgaccccttggatggcaggtgatccggttactttttctacaggtaagcgagtttccggtttgcatcaattgcccagtacaattttggctgctgattatgattattattgtatatcagaaaatcctgaagggcatacctatcataatatagggacagtacgtggaaatgagtatcgtccggatggagcagttgaattacagaaaatagataataaatacgtagtggttcaggtagaagacggcgagtggatgaattatactgttaatatccctaaaagtggagcttacgctgtttatcttacttattcggcaaattcctcttcacatgtagcaatggcctctgatcagggattagaaatctcgtcttcgatcccttcttctaaaaagtggaaagaaacaaaacttggcgaactttcactttcggctggtgcctgtgtattgcgtttacgtgttgacaaggccggacaaaagttatgtctcagtgctttccgattggaaaaagtagaaagggatagataaagtggtgatatgatataagtatgtgtgaagcatttttagggagtaattaacgtattactcaagtaatttgtaggaaaatatagaaaaagaacagaaaaatgatcattatgatattataaattactatttttgtgcactctgttacaggatgatattctgatcctgataattgaaccgttgagcatgttttatattataaatgatagatatatgaaattattaatttttatttcgttatttggaggcttattgttagcctcttgtggtagcagtagttcacaaaaaaatgcaagtacacaagaagtaaatccggcagacactatttatttaggtgatttacgtgaaaaatttgaaggagatagtattttctttaaggtggttgctcctgacttgatgctgatggattaccagtatttctgggcggctacagagtctgaagctgtggagaaaggactgactaaagaatattataagcgtgttaagaaagaaatttcagaaaccaatgaagcaattaaaaaaggtgtaatgaaaggtgcggatgtaaaacgtataccggatttccaagaaggacaaaagaaataaatcgtttcaaagagaaattgattattgctatgatagataaaaagaagggagatgttaaatatgacttctcccttcttttttgcatcaatgtctggtgaaagagaatcataatttcatctgacgttttatttcatcatccactaccgtcatcataccctctacttgcgccagtgccagcatacgtccataaaaagaatagcctggattataccccttgtcttcatctcccagcatcattctcccgtgatcaatgcgcataggtaatcccggattttctttctcaaagattcggataaggtcaatgatatgtcctcttcctgccaggtgagaactttcaatgaagtttccacccggcatggcggctgtgctgcgtaggtgtataaagtgcgtacgtttagcaaacttctttgccaattcgcgggtatcattgtgttcgccggcactcaaggaacctgcacagaatgtcagtccgttgtgcggattgtctactgcattcaggaaccaggctatatcttcttcattggtgacgatacgaggaagaccaagaacctggaatggaggatcgtcgggatgcacgcacatattcactccgtattcttcgcaaaccggcataatggcagaaagaaagtgacacatattttctcgcaggatgtcacggttaatatctttgtacaaagttaacaaccgtttgaaaaggacgaccggttctttgtctccttctttgatgttcccattgacaaatccttgtgtcttaacgataatggtatcaatcagatcatccttctctttttcggtgatcacttgatccagttcggaaactttatgaagttcttcttccgtataatccttttcagccccttcccgttccagtatcttcatgtcgaaataggcgaaacggatacggtcataatacaatgagctagtaccgtcggggcagaggtactgcaagtctgtacgtatccagtcgatgactggcataaagttatagcaaacagtttttattccacatttacctagattggtaaggcttactttgtagttctctatcaactgttcacgttctgtcccaccatatttgatcgcttcgcatacgggcaaactttctactacagaccagcgcagtccgtatgattctatataggatttcagagcattaatcgcttctattgtccatatttctccgttcggtatgtcgtgcaaagctgtaacaatcccttccacacctatttgccggagcattggcaaggtaatcttgtctttcttgccaaaccatctccatgttttttccatcatagtttcttctctttatacgccgctgaatgcactgaatccaccgtcgataggcaacattgcaccggttacaaaactggcagcttcgctacacaaaaattgtacggcaccgttcaattctttaatatcaccaaaacggttcatcggtgtcttggctaaaacctttttgcttctgtcagtcagcgagccatccggattgataagtacgcgacggttctgatcgccgataaagaaaccgggagcaatggcatttacacggatgccgtcaccatatttcagagccatctcactggcaagccattgtgtaaagttagctacagctgtttttgcagccgaataccccggcacacgggtgatggcactataagcagccatagaagacacattgataatgcaaccttttttctgctctgccatcactttaccaaagatcatagacggatagactgtaccgttcatattcagactggtcactttctcccaacaggaaatgtccatatcatagaagttctgatccgattcaagagtggctcccggcatgttgcctccggcaatattcaacagaatatcaatctgtccccattgggcaacaatctcttccgctactttttccagactggcgatgtccagcacgtctccaataataccgataacatcctgaccatattgtttaagttctgctacacggttgtccagttgttcctgacggatgtcgatagctacaacttttgctccctgctgtacaaagtgctgggcgatatttcctcccaacacaccacctgctccggtaattacagctaccttaccggcaatactaaataattcgttcatggttttatttattatttatatgaattcattgctgtcccattaaaatctaaaagagttctttgaaatatttgaaatttagttagttacagcgattttccgagcgaacggacttgaatttgtagctttgcatcagattaatccgatggcatatgacacaaataacaaatgaattaaatagatatgtcttatcaaatacaatataatgatttcccaacctttctgcgaaaacattttccttacaaagtgcagaaaatatcattaaatgccggttttacttgtcctaatcgggatgggacgaagggatggggcggttgtacgtattgcaataaccagactttcaacccggactattgccggacggaaaagtcgattgctacccaactggaggaggggaaatgtttctttgcccataaatatccggagatgaaatatctggcgtatttccaggcatataccaatacttatgcagaactggaaggactgaaacgtaaatatgaagaggcgttgcaggtagacggggtagtaggattggtgatcggtacgcgtccggattgtatgccggaagaactgcttcagtatctggaagaactgaaccgccatacattcctgatggtggaatatggcattgagagtgccagtgatgagacattgcggcgtatcaatcgcggacatacgtatgcggatacggtagaggctgttcagcgtaccgccgcctgtggcatactgacgggcgggcacgtcatcctcggtcttccgggagagacacatgatacaatggtagagcaggcaggaatcctttccgcgcttcctttgtccacactcaaaattcatcagttacagttgattcgtggtactcgcatggcgcatgaatacgaagagaatccggaaggttttcatctgtttacggaagtggacgaatatattgacctggtgattgactatgtagagcatctccgcccggatctggtattggaacgttttgtttcgcagtctcccaaagaattgctgattgctccggactggggactgaagaattatgaatttgtaactcgtttgcaaaaaagaatgaaagaaaggggagcttatcaaggtaagaagtacagggattcagaaaaaagagttatttttgcggaagataacttcaccacagaataaatctctgtcctcagaggatcatagctggtgagcagaaattaattaaagttgaagaatggaacagaaaacaagaattaaaggaaatgtccactatgtgggagtaaatgaccgtaataaacaccgttttgaggcgttatggccgttgccctatggagtttcgtataactcttatttgattgatgatgaaatggtggcgttggtggatactgtagatatctgttattttgaagtctacttgcgcaagatcaagcaagtaatcggcgaacgtcctattaactatttgattataaatcacatggagccggatcattcgggctccatccgattgattaaacaacactatccggatattattattgtcggcaataagcaaaccttcggcatgattgaaggattctacggtgttaccggcgagcaatatctggtgaaagacggagacttccttgcattaggcaagcatatgcttcgtttctatatgactccgatggtgcactggcccgaaacgatgatgacatttgatgaaacggacggaatccttttctcaggtgacggattcggatgctttggcactgtagacggaggatttctggatacccgtatcaatgtagataagtactggggtgaaatggtgcgttactactccaatatcgttggcaaatacggtagtccggtacagaaagccctgcaaaaattgggaggactgcctatcactaccatttgctctacacacggaccggtatggacagagaatatttccagggtgatcggtatctacgaccgtctgagccgttatgatgcggacgaaggtgtggttatcgtatatggcagtatgtatggaaatacggaacagatggcggaagctattgctgcggaactctcagcacagggaatcaggaatattgtgatgcacaatgtgacgaagagtcatccttcttatatccttgcagatattttccgttataaaggattgattgtcggttctccgacatacagtaatcagatattcccggaagtggaatcgttattgtctaagattctggttcgcgaactcaaaggacgttatttgggatacttcggttccttcacctgggcaggagctgctgtgaagcgtatggctgaatttgcggaaaagagtaagttcgaactggtaggcgatccggtagagatgaaacaggcgatgcaggatattacttatacccagtgtgagaacctggcacgtgcgatggcggaccgcttgaaaaaagaccgctaaataaagaatgaacaattatttactaacctataaaacaatcgacttatgagacttattattcagccggactatcagtccgtatctcagtgggctgcacattacgttgccgcaaaaataaaagctgccaacccaactccggaaaaaccttttgtattgggctgtcctacgggatcttcacctctgggtatgtataaagctttgatcgatttaaataagaaaggaatcgtttctttccagaacgtcgtaacatttaatatggatgaatatgtaggcttgccgaaagaacatccggaaagctattactcttttatgtggaataacttcttcagccatatcgatatcaaaaaggaaaatacgaatatcctgaacggtaatgctcccgacctggatgcagaatgtgcacgctacgaggaaaagattaagtcttatggtggcatcgaccttttcatgggtggcattggtccagacggacacatcgcattcaacgaaccgggttcttcactgacttcccgtacccgtcagaaaacgctgactacggatacaatcattgcgaactcccgtttctttgacaacgatattaacaaagttccgaagacagctctgactgttggtgtaggcactgtgctttctgctaaagaagtgatgattatcgtaaatggtcacaataaggcccgcgcattatatcatgcagtagaaggttctatcactcagatgtggactatcagtgctttgcagatgcacgaaaagggtattatcgtttgtgacgatgctgctacggaagagttgaaagtaggtacttaccgttacttcaaggatatcgaagcaggtcatctggatccggaatcattgattaagtaagaaatattcaggcacggatttcacggattaacacgttttttagatatgtaatcttttaaaaccgtgaaatccgtgtagtccgtgcctgatttatatattctctaagttaatagtcttcgggattaaatcccttccagccagccttttccctgacggacaatttccggttcatcttctgtgcacttcactactgtagaaggttctatgcctcctattcctccgtcgatcaccagatccacgatatcgccgaacttttcgtcaatcagttcgggatcggtcatatattccagatcttcatgctcatcatatggcagtgtggtggtcataataggagcatccagtaagcgggcgatttcacgaatgatgttgttgtccggcatacggatacccacctcttttcggttgcggaagattttgggcagccggttggtgccattcaggataaacgtgaacggaccggggagattatgcttcatgagcttgaactcattattacccactttggcatactcgctgatactgcttagatcgtagcagatgatagacaggttgtttttgcgcggatcaatatctttgatccggcaaatccgttcaatagcacgttctttcagcccgtggcatccgatggcgtacatcgtatccgtaggatagatgatcagtccgccgtcgttcaggatgtcggttacccgttgcaagtcctgcgggttattgtttttatcgtacagtttcagaagcatactctcttctccttttcttatttaagtttcttctttaagaaatcaagtgctttctctgtagctttttccgtcactttctgtttgatggaatctttgttggcagtcgtggcagaatccagtccgagcttttctcccagtttgctgattgcttcgtcggctacggattcaagtgcctgattggccatactctttgtatcgacactgactttcggggaagtgaatgaaccgccgatcttcagatcgagtgtcatcagcttggaaatgccggtggatgccggaagcttgatcttgccggagtagtcgatggtctggtcgagtcctgtgctaccggaaagattcagattatagtcacccattttgatatcaaacggtttggtttccacccgtccgtctttgatagtgaagtccagtgtcatatctttcactttcatttctttcagactcggttggctgatggcatcggctatctggtcgattgctttcacaccactcagactgagatcgcgggtagacaagctgccgtctccttgcatcgtttccagtaccgggctcatggctgcgtccaggtcggtcagcacattgatgctgccggagaagtttcctttcaggttctcaaagataggagccagttgctgaaccatatccagttctttgtatgcttgtgagaagctgatatccgacagtttgaatccggctttcatttccggtttcttcgcattggcggtagagtaatatccgttcatcaccacattgccgctcatagtgcccatagaaagattcttcatatctacctttccgtctttgacaataagtttaccgttcatattgttgaatgtcatcttgtcaaacagcacctgtttcagattggcgtccatctggaagtcgatattgcgcggaacttctattacgccggcaatcgccgtggagtctgtagcagcagcctcggtagttgccacgctgtctgtggaggctgtcatgaaatcattcagattgaaataattggaatggatgttcagcgttcctttcagcgtagtacctttcagagcgtagccgatatagttctcgaaacggctgtcggcagtaatatcgttcttaccgatattgaccgtcgtttcgctcagttgcagatatttcggggtgaaggtgaagagtgatttcttgatatccacatccggcatatcctgcattttcagtttcatattggtcagaccgatggttccggaggctttcatgttgtcgtactgttctttctctatataagaaagacgtccggacatttgcatatcggcgttgatggttccgttcagttccatatctcccaaagggtatacctgtttgatcatacccaggtcgagggtaccttttgcctcagctttgaaatcggggtcgctgaccggtgttttcacgtccgcagtcagactgaaaggatttcctgccagacggaaactgaacgggttgatttggatggtggtcaggtctatatttcctcccggatttcggacgttggcattaatgttgatctgatcgactcctgcgggcaatgccggatagcggaacatagcgttcttgacttgcatgtcgatgttgaatgcggggacagtatctccttgcagcgtacctttggctgatgcggcaagagtagcggttccgtctgttttcagactggagaattccgttgcgtaaatggcaggaatcaaagacagtatttccttgaagcctacatcattggtattgagtttgagatccatgtcgatagcgggatctttcagttccacccaaccgtcgatacctgcctgaatggcgttgaggcgaatggtattgtctttcagtgtatacttgttgttggcaagatcggcgtctacatccatcttggcggagatgttggcgtttgcaaggaaaggaatgccattcatcttgtaagtcagtgatttggtttccgcttccagtttcagcgtagtgcggtcactgcccaggtcaccggcacaaagggcgttgaaatcacggatgtcggcatacattttaccttgctggtcgtcataaatcaaattcatgttcttgatgacaaaacgttgcagcttgactttgaaaggagatgaatcttcttccgcggcaggcgtttcctgcgtgtctgtcgtgtcgggcttcataatatcccagttggcacgaccgtccggcaggacaatggcgtgcaggcgggtatcttctatgaatactttggagatgtcataaccgctgtctccgaaaagggagaacagattgatggtggcagttacctctccggcttgtacaagggtatcatttgcgaattctcccgcgcctttcagccagaaatcttcgagagtgacagaagcctgcggaaagttgcggaacaggctaatgttgagtttcttgaaatcaaattgtgcattgagcatcttgttgccttctgtttttacaatacctgctatcttaccttggaaggcgaaaggaaggaggagcatcagaatgattattacccctacgacgatagctgcgattttcaaaccttttttcatttgcttttcttttaagagtttgacgtacatacgaaggcaaagttaataaaaagtttttgatgtaagatgatattcaataactttcacaatcagaagacttctgatacactaccaacttatttatgattttttctttctgagttcctcggcaattctccattgtatggcggcttccacttctttccccactctcaacagggcatctccgaaaagctcgtgtgcaccggcatgctcgggtttcagacttgtagccttgtccaggtcggcaattgctccttcagtattatcgattttcagacgcagttttccacggttgtacacagctttaaagtttgcaggatgaaggctgacagcggtattgaaacagttttccgcatcaaaatactctttgctgttgaacagggtgattcctttccgtatccaggcgtctatataattagggtcgaggctgagcgctttgtcataattggcgatggcggcacgggcgtcgtgggcttgggtgatacattcatttcccattaacagatattcgtgggcatattgccgcagacgttcctgctgttcccgcatttgctctttgagctttttgttctgctcctgcaaggtgttgataatccccagtttccggcggattaatcggcggggaacaggtttctctatgtcataacgggagtgaatggcacggaaaaattgttccaggcattcttccatatcccctttgtcgaatgcacgtgcggcagcggcatactggacatcggcctgcgcctgtttcagagccttgtcgatggcttgccggtcgttgaaccgtccggcaaagtttacgatttcgggacgcacaaagatatccgcccggttgatcggctttttgagctggatgccatccagtgaggtacaacggctgagtgctacatacgcctgtccgccggcaaatacacctcccgtgaagtcaatcactactctgctgaaagtcaacccctgactcttgtggacggtaatggcccaagccagccgaatgggatattgggtgaagctgcccagtacttcctcttcaatctctttcgtcttttcgttgtagcgatagcggatgttacgccatgattcccgttttacatcgcattccttgccgtcatcggtgatgacgtatatcgtttcttcttcctcgtcgataccggcaatcactccgatggtaccgtttacccaccggcggtcgaaatcattcttgataaagatgatttgagcacccggtttcagaacgagttcctgtgaggtcggcagactactttcgggaaaatccccttcaatgcttccctcaaaggtgatcggttctcctgccagctcggccagtttcttctcattgatcgagtcaaccgtatcccttcgggtggcaagcgtgatgtacatatcggcttccgattcttcgatatggcttccgtatcgggtgttcagcagttgcaggtcggctgctccggcggtgttggtacggatatggtcgagaacgctgacaaagacggagtcagtttgccggtatactttctggagttcgatggataccagatcgatctggctgaatactcttgccgagaagaagtatggagtagggtaggcacggttcagaatctcccgctcgtcattcttcacgacaggttccagctggaaaacgtcgcctaccaataacagttgtttgccgccgaaaggttcccgtaaattatgtgaatatacacgtaagatgcggtcgatggcgtcaatgaggtccgcccgtaccatagagatttcgtctatgatgaccagttcaatctgttccagtaatttccggtgcggtttggtgtacttgaagaactcgtgaatgcgtcctctctggagacttaaatttggatcgtccggcagtaacggatagaaggggagtttgaagaaactgtgcatcgtacttcctccggcgttgatggctgcgatgccggtaggtgcgagaacgacatgtttcttcttggtatgttcgcagacataacgtaggaatgtagatttacctgtacccgcttttccggtcagaaaaaccgactggcgggtatactgaataagattcagggcgtcctgaaaagctgcgttattagtgtctacgctcataaagttagtgacggataagcagatgtgctgaccggataaatgaattagataatcccgaaatgtttcatagccttgctgatgccgtcctcatcaatgggggctgtcacatagtcggctgcggcttttacatcctctttggcctgccccatagcgactccgatagctgcgtggcggagcatgctgatatcgtttcctccgtcgccgaaggacatcgtttcttccaacttgataccaaagtgccggatgatttcatcgatgcctttctgtttggtatcgcctttggctgtgacatccgcaaaagccggataccagcggcctatttcgcaagtcgggatggatggaagcacttctttttcttcttcctccgtgatgaagggagtcatctggatgacttctttattgcttgcttcttcaaatgaaactgtcggaatgacatttacatgcaggaagtcataaaagatcttcttcaccatctcattcggttggcaaacagagatattatgctcctctacgaagatgcaggggactcctttcttctcgcagaaagcagccattgcttttacttcttcctgcgggatggcacttttgtaaattacttcttctccgacaaaacaataggctccgttcatggttatatatccatcgatcaggttccggtcctgcaattcggaaagattgttgataatggctttcgggcgtccggtagcgataaatattttaagcccttttgcgtgggcggcttccaatgcctcaatggtagaagacgggatacggtgtgtttcgaaactaaccagcgttccgtctatatcaaaaaataaagctttcgtcataaattccttttagtccaactgttgatatgtagcaaagataattcttttcggttatataaacctaatgaacaggtacaatttcgtgataatataatcgtctcacttccttctgcctgatcaattttatatatttgtgctatggttccatattattcttattatcgaaatgttctgtttttaagattgctgtaggaaaaaatagctcaaaaactaataaactggagattaaactgtataaatagacgtaataatatgcagaaaagtagtctgattctgtataaaactgtatggtatatgtatcttttcttgtctgaaaatagaagtgggaagaaaatactttttcttcccacttgatttaatcaccgactgctattatttttttcccattgtaaacataatctctgcaatacttgcatttacgccattgttgctgtcggtcactgtagtacggaaatatcttccacttatagcctttggtaataagataatttgtgcattaggaaccttatcattaggaaaatctaattttcctaattctgtccagttttctttgtcatcactgatgctgaacatgactgcttttaaatcaaggttattttggcgcctagccaattctattgatagaatgttttgtgtttgttgcatatcaaatatgattatatgtggcaatggtggattcttcccttcaccatcccattgtgaatgccagaaagtatttaaattaccatcaattaatgcttctttatgcccgtttacggctccttcaccggtcaattcttctgtgttagcctcaactccccatcctgtcctgtccacatcgatatattggttatgaatctcgtcccactcttcttttgatacagtataataggttggaaaactcacaactttttctaatgatggaatttcgtcaatagcctcctctgaaggtttaaaataagaagttactttaaactctgtatcaagtacggcatctggtatgatagaagttgttgctccttccatcaaagtgattgttttttcgctgccttcgttgttggtataagtaaacatcgtttttgtacatccttccataggagcccatttaatggtaactcctttcgacagtgtcgcttccatagagttgattccttgtgcggataacccagcttgataggaagacccatatacttcaccggaaatggtttgtatcagagattcttttcccgtttcactcttatttattatcgaaaagatatatttcccttctggaagatcaattatctttgagatataatcattgatatcacgatctgcagagatgggtacctcaattggagtttcgcatccttcccaagaaatgatactggcattgattcgaggatcagcatttagtttccatttcaattcaatacggttgaaaccgctgttcgcttccaaatcactggcgattccgagataggtctcttcacccattttaagatacttttcgtgtacatcatacatatctccgcaagcagctattccgagaattagcatgctgcaaactatatagtttataatatttttcataatctaattattaagttatttcccgataggttgcccccaaaaggtcatttcaccgatctgtgcataagtacctccactccaattctcaagcatgtaaattcgaatgtaacggaaattgggtgcatctagtggaatctcatgttcgtcaccgttttcaatatattctaaatcttcatttgttttcgtagggttatcgcttccagaaggtttataacactctacttccatgatttttgtccatccttcgaacgtaggatatttgatgccatcttcttttacttcacctcctagatacatattatccgtaagtgcttcacaaccatagataacatatttttttaaattgttatggtcataagcccatacattaactggatcatttcctctacgctgatacattttaaaacgactgactttggctacctgtcccatgtcaaaagttatcgtccttccaattgcagggtttgtcgtattcgtaatattatggaaacattccatgttgtaatcaccttgccatatatttcgtattggcaaaccggacattgcttcacaatcaccaggtaatggattaacttccttgaataaagatttagacagttcttcttcatacaaaggcgtactttccttttccagcatctgagaatagttctcccagcgatcttgaattctatatcctagtgttattggttctgcagccaaattacggattttggctactccgtttagtacactagaatagaaattttccagagatatccattccccatcatcttttttaaacacttctaaaataatgttttcccttgttggattttcccaagtcagactaaccccgccaaaactattttcgactttcagagaattataaataaattcgacgggtggagtcaacgggcttatcgttaccgaaagtggttcagattcgttcctgcttttatctatactctttagagtcacttgatagtcacccactttgccgaacccttctactgtaagtttgtttacataaggagaggctttagtagttctttcttttccattgatcatataagaagctactacacataggagatcgtcatctttaggaggagtgtagctgatgatagctccaccgttaatattttctacttttatattgctaggcaatcccggtgctatattgtcagtcgcgtcaagtccaattctgtcgtcttgtccgcatcctgtaagacacagtataccaattaaagtcgcagacatatattttgtcagctttaatatataatttatttttttcatctttccagttttttataacatgaatacggtgattaccaacccggattctgtcccaggttcggatctttcaatacagtttctacttttaagggccacaagtaatctttaaaactgtatctcgaacgtagataaagcgtagtgacacggtaaaattcttgtgctgtttctccttgtacataccaccccttcacttcacgaggaagttccttcttccaacgacgtaaatcccaaaagcgttttccttcacaagctagttcatttaagcgttccatacgaatgatttcacgcatacctgttttcgtgtttggcttttcaggatactttgaatatttttgccaggattcctttactccgtcaagaccagcgcgctcacgcactaagtcaatataggtataaacatcgttgttaggggtgttgagcgtttcattcagtgcttccgcatacatcagatacagatcagcaagacgaataatcggaaatgcataacgttccgttgacagaccgttatcagtcacactagttttatagctacatacttttttgtttaaatatccagtatatgaatagtcttcggaagtaatacgaccagaaacttctttagcgcgaaatttatagaaagccagatctttcggttcatcactggcataaccgtagccgtaccatgttccacgatcgaatgataggttagcataaaagcgtggctctcggttgaggtgaagatacgccgtttcttcaccgattttgagataatgcttattatttccttcatcaggaatgatagtgaaatcataccgatttgggtagtttttcgaccaaaagtctcctttatcttcggagatgggaacaccgttagaggaataaaactgttcggcaacagttaaggtcggagccattacagatattgcatcgtagtgactgcccttagttgttttggctactgctaccttttgtaatccgttgacgttccatgtacttccccatataatttccgtattccatttctctgtaactgcttcaccgatatcaagtaacttgcgtgtagcatccgaaagtccgttaacgggcagagtgaaatagtaaaggtcatgtccggcttctttggcgcactttatggcgtctaaagctgcgtctgcagcctgtttccatttgttattatctgtttcagagggaaaaagacttcttccttgattatcttttacgttgatataatcggtatttccattgaatagaggactagcagccaataaccacaattgtgcttttaccgcttttgctattggttgggtgattcgtcccagttcttcacctgcatcagtgacttgaagaggcagatctttagctgcgtcatccagtagattggaaatatagttgactacatcgtccactgggtcccggtaacgtcgtacctcttccgcagatgcatctatcgaaatgttgttatccatgatagggataggaccatagagcataaatagataatagtggtagtatgctttgaggaattttacttccgcaatccatctgttacgttcatattgctgtaaatctagaggcttgtcaatattttcaagaaagatattgcagtcgcgtatagcagtccaaagatttgttcctccattaaggccatcccaataattctgataagggtcattactgttctgttctccacgaccgatttcccaagcgttgagactgaggcgttgatctataaatccggtacctttgggtattaaccaatgttcatcacctgctagaaagccgatggaaccggcttgatcccactttggcaggtaactataacaagtaaaaagaaacttacgggcatttgtcttgttgctgaaggctgtttccatgtccggggtaccttcgggcactatatccaagtaatcactgcaagatgtattgcatagtatagccgtaagaataaatgatatggatactataatttttttcatatagcaaattttagagtgaaagttgaacacctatattaaatacacgttgaacgggatatccaagaccattgcctcccatttccgtatcccatgttttaaacttagagatattgaacaaatttgttccactcacgtagatacggaagttttcaagtttggctttactggatattcgctttggtagtgtatagcctatttctgcagatttcatacgcaagaaagtcccgtcacgtagccaccatgtacttttttggttattattactaatagcagtatctgacaaacgcggccaaaatgcatacatgttctgattggcttcgctccaatgatcgtctgcgacaatttgcaaaagagcattagttgcctgtttacctcctaattcattattcgggtcattaggttgtatgaaagggcttatatctgcaggtgatataaagaaagaagaacgtgatgatccttggaagaaacagttaaaatcaaaatctttatatcctattgagaagccgaaaccgtaaataatctcgggagtagtaggataaccaataggaactctgtcctgttcgtcaataattccgtcatgattaatgtccttgtatttgatatctcctgccatatattctccaaattgttgtttaggagagtttgctacatcttcttcatctacaaataaacgttcagcaatcagaccgaattcttggctgagtttcgttcctattttacttctccatggagtggctgaataatcgggttcttcgtacttggagaacttgctactggcataggtaaaattacctctaatggtagcccataaattcttgttgaagaaatgagaatagtccagtgaaatatcgacaccatgtcctttggcttcaccaatgtttgcctgcggagagacttgaaaacccattagagttggaatatcggcacgtgtctgcaaaatattggttcttctttctttaaaatattcggcttgtatttccagatctttaaatagtttcatctcaaatcctacgtttagtttatgagagatttcccaacctatcttaggattagcataacgcttgatggaaatcttaccgttagagttctttgcattgaaatttgttccgaatcccataccgttatcaccatccatgctaacttcagatagatagaagaaacgttcgtcagaaatattatcattacctactaatccataagagcctttcaattttagtgaactaattacttttgtgataggtttgtctttccaaaatttttcattggaaaccatccagcctagccctcctgatgggaagaatccccaacggtggttcttgtcaaaacgttctgaaccgttgtagccgaaattgaattctgcataataacgatcggaatatccataagtgaaacgaccagctatccccatattacgtgatgggagtgataattgtagagtttgtgcatttccagattttgattcacgtacggtatataccatcattccacttatattatgttttttataaaatgtccggtcataagatagagatgcttccaaatacagagaactgtcaaccgatttgcttcctggattatatgatagatagtctgtacctttgtccgaatttaaggcgctaagtatatatgtgtccgtgtacttatcataactgtctaaagaataatagaacggagtatatgaacgggtgagatcataataagagtttcgcgtgacatttgccaatagacgtccgttcaatccgtcggtgatgaaaccgaaatcttgtttaagttcgagttgagcaagaacaacagttttttcatattctttatatcctctggccatttctgcataagggttcagatagtttgcactgcttcctgagttaccgaataatacatgtttggtgttaatattcgtttcatcaggagcatacatagcaggaaattcaacagggctggctttaatagcttggctgtatatggcagaaccaccagataacggtccttgataactgtcgaatgtgccactaatacgtacagctaattcggtcgtcttggttaagttgatgtttacatttgaacgtactgtatatttgttcagcttgatgttattatcaaagatattattaggaacttgtttgaggataccattgtctcttgagtaagataaggctacatagtagcgggctacccgaccaccaccactgatgctcatgttaccacgatagtttactgtgtaatctttaaaaagcatgtctttccagtctaccataggataaacatatggattcaatcctttttctcgggcagctattgcactttcaagataaggtaatgcattgcctggatttctagtccttgcagcttcgttatgaagtttcatgaaagttagcggatctgctaattctacctcttttgacggggcagagaatgaactttctgctctgaatgataacttcattttgccttctgttccttctttagtcgttaccaagataacaccattggcaccacgtgcaccgtaaagggcggttgcggttgcatcttttagaacagaaaaactggctatatcgtcaggattcagtcttgacagatccgaagaagttagttcaacattatcaattaaaatcagtggatcggctttacctgtaccaaaagtagttacaccacgaataaagaactctgcattgtcttctcccggttccccacttctttggtaagcaaccacaccagctaactttccagcaaaacctgttgttaagttactgctagtcgtttttaactctgcaggcttaatagtggagactgaacctaatacagattcttttttttgcttggcgaatgctactactgttacgtcctctagagctatcccgctatcttctttcatggtaacaacgcgaaagacatttagatttttaggattgaactcgatgatcttcttttcatacccgatataagagaattcaatagttttagtattagccggtacctttaaagtaaagtttccgtctaaatcagtggcaactcctgtattggttcccggaatataaacacttgcgccaatgataggctcattgttgaaatccaggacaatacctttgatcgtgtaagtttttcctgtctgttgtggcgatgctgtatcctgtttggcatagagtggagtaaaacacataccatacaaacaaaacaggattaatatttgtagtattcttccaccactattttgtttttcattaatcatagaaattaaaagtgttaacaattcattcttgtgttttcaataagcatgaatcttgtggttaattaaatttttcgataagtttggatgtgatatcgtatgccgtaccgtagctctgtccgccgaaagaatcggttgtaccatagttaggtgcatagatagtataacgggcaaggttggagatttcctgattaccggtctgtccccacgaagcacgcaatttcagatcatcaagccaggtcagttctttcatgaagttctcctgtgtgatgcgccatcccaaagatacggaagggaaagtggcataacggtggtttttaccgaaccgggaagaaccgtcccgacggagagttaacgaaagcagatatctatcggcataagaatagttcattttgccaaagaaagagacgagtgaatacccctcaccggcaccgtatgcttgtgccgtgccactacctgcatcgggccacatatagtcgggggtaaggatagagaagtcttctttgtatccggagaaatggctgtcgtcttcacggttcaactccatacctatcattacatctccacgatgtttgcctacttccagttggtaggtagcaatggcgttccacatccatttcgtccagtgttcctgcttggcttccactgcgctcttgccattatttgtctgcgttccttcctgataaggataagtgaagtaacgtgcctgcttgttggcatagtccagaccgaaagtggaacgtagattgaatcccttgaaaggagtcagattgacataggcatcaccgaacatacgccagtaagtgtatcggttgtctttattgtattcaagtacggcacgagggttacgacggtcgggccatccgcctaccggtccgccccatgaaccatccgaagcatatacgggaatagcggaaggaatgtccagtgcggtttcaataattccacccggagcctgcacttccgacgtgcgatttaatgtaaaatgctgaccgatggtcaggatatcatcaatcaacttataatcgctgttcatacgagccgagaaacggtcgaagtccgtgtctttgataacacccagattcttgtaatatcccagagaaaagaaagaagaacctttctccgaaccgttgctgacggaaagattgtattgctgaataacaccagtacgagtgatctcgtcaaaccagtctgtgtccgccacaggcattgtattctttgaatccaggtatttggaaagagtcattccgtataataccggattgccgtcggcattatatccccaattgtaagcatatcccaaagcattaccgttcggattttcaccgtcgttcacgtaggcttgccacatagctcgtccgtattgctcagtgttcagtacgttcattttactctgatacatggaggcggaaacagaagcgtcgaaattgattttgatctgtcctttctttccttgtttggtagtaatgatgatcacgccgttcgctgcacgcgaaccgtagatagaagcggatgcggcatctttcaaaacctgaatggattcaatatcattaccattcagttcgtgcataccggctttggtaggaacaccgtcgattatataaagcgggtcgttattgttcagcgtaccgataccgcggatacgtacggtagccgatccactcggattaccatcggcggtgatgttcattccggggacacgtccctgaagggctttcaccggattgttttcaccttgcttctggatttcgtctacttttactacagaaacagcacctgtcaggtcggctttacgctgtgtagtataacctgttacgacaacttcatctaccatctgggtatcttcttccagtagtacattaacgatagcagccgcttttacggtcaccggtttataaccaatatacgtaatctttaaagtagagttgaccggaactgaaagagtgaaattaccatcgaagtctgtaattgttccgttggttgtagctgtagtttcaacgacagaagcaccgataatcggttgcccatccgttttagaagtaacgtttccctttaccgtaatgttttgcccccacagggccgacatgaaagcaaacaggaaacaaacgctgcaaagaagttttttgttcttcatgataccaggcattagtttaatgttattaatttaaaagtacgaattttctcttttcgatgatgcaaattacggttgatttaagtcaaccgactgaaaaaaatgtttcaaatgctgtaagatatgttgcatagaacgctattttatagggttttataagaataattctccatcataagaaagtcgggattatattctctctcaatcatagaaaatactacctttgtatagtaatttaagtccttgtaaaaagggatattattcatataacaagcatataatcactcaaagtaaccaacagaaaactgaatgatatgaaaacaatctccaacgaacaacttactattcaggtatctccgcatggagccgaactttgcagtatcttcgccaatgggaaagagtatctgtggcaagccgaccctgctttttggaaacgccactctcctgtacttttcccgattgtaggaagtgtgtgggaaaaccagtatcgtaatgaaggtatcgcttatacattgagtcaacatggctttgcccgcgatatggaatttactcttgtttcagaaaaagaagacgaagtacgataccaccttgtcagtaatgaagagacattacggaaatttcctttcccgttttgtctggaaataggttatcgtattcagggtaagcagatcgaggttatatgggaagttaagaataccggagaaaaagaaatgtattttcaaatcggtgcgcatcctgcattctattggccggattttaatgcagatacacagaatcgtggtttcttcggttttgacaaggaagaaggattgaagtatatcctcatttcagaaaaaggatgtgcagatccttccactgaatattctctggaacttacagacgggttattgccattggatacacatactttcgataaagatgctttgataatagagaatgagcaaatccataaagtaaccctttataccaaggaaaagaaagcttatttaagcctgcactttcatgctcccgtagtcggtctatggtctccgcctgcaaagaatgccccttttgtctgcattgaaccgtggtacggccgctgcgaccgcgcacattacacaggcgaatacaaagacaaagactggatgcaacacctgcaaccggaagaaactttcagaggagggtatacgattgagatcgatgaataagtaatgacagcctattctgcgaatagactgaagaaacacagaacagctgccggacctcacggacggcagctgccaaacacctaatctacaaaacctaacttaaaaactaactcataaatccaatctatgaaatactgattatacaagtgataaacaattgattatatccttgataaatacctattgaaaaataaatccatccttttataaacctaatctatacacactaaatgaatcgactgcgaatgtaccgcccttactgtaaaaacacatacgattgtatggctctgtagggaaaatcagattagtcatcgctatcttcccgccatccagaaatatttctaccgaacacttatcaacaaagacatccagtttgtattcattttccttctggataggtgcccatgtagccaatgcgaaatcatctatataattgatagaagtcgtcttccggcggtcgtgcgcctcgatctcgtgcggagagctgtttttcccgaaatctacgatgccgcttttcgtacggtccatcaccagtttcttttccggaagattaaaataaatatccaccttctctcccttgtcattgaaaagactgaatcccataatttccgcctttccagcttcgatgttcagagaaagctcataagctccttcattatcagtcaataaagattcgatgtgataatccttgtctaccgtgaaggacggaacatccttgctttcttttcgtaagttcttagtttccgctaccggtgcggcggaaagataaatatcattgtcctgtgtatagagtcccaattcacggggcagtgcattggcactacggaactgccgggtcggaacgatattgcaatactgccagttgctcatccaaggcactgccaccacacggtctcccgtatttgagaaacagacagtagcatagtgatctttcccccagtccagccattttgtgacattcggctgattatcacaaataaattttgtgccgtcaaagtcaccgataaaatattgagtagcactccctccgaagtaacatcccggatttacattgacaatcaatgcccatttcttatagttgatatcgccgtctacaggaagttccaccatatccggacattcaaactgacagggttgcacaccgtatccttcgccaaagctactcaggtagttccagtctttcagattatgggagtcatagaaacgcatttccttatcggcagagacaatcatcacccatttactctccggtgcataccagaagactttcgggtcacggaaatctttcagaccatcggaaggacgcagaacaggattcttttcgtatttagtaaatgtccgtccgttgtctttgctataagccagacactgaatctgtccgttcttatcgctggcagaagtatagtaagcgaggatggaacctgctccgtagcccgccacattctcctgatcgacaatagaactaccggaaaagatatgccctaatgtatcacgggcaatggcaggagccaaatgttcccaatgcatcaggtctttgctgaccgaatgtccccagtgcatatttccccatttggagccataagggttatactgataatacaaatgatactctccatctttatataccaatccgtttgcatcattcatccagccataaaggggagtatgatggtagacaggacggaatttatccgtattggtagtatcaaacgtatcggataatttgatttcttcccagcagagggcgtctttcgatttcttttgaatgcgtaaagtggctacctttgtatcagccggcaaagcaaaaggaacgaaataatcgaccttagtctgtgccaggcggatatccatatcggtatccgctgcattccccgtatcaagacgcacctgactttcgtcggcttcttcttcttcgatggggagtaatatataattagtaggatgagtaatatggacaatagtaaggctatcacctttctgttcaagagtgaacgtgcttttggtcgactggcaataggtcagtccaaaggagacagtcagtgcgagtacggcacctttacacagttttatccaaggagttgttttcatggtaacaggatattcagagttatactagtgttaatcaaaaattgacggaggcaaagatagggggtatcttcaccttcgtctataaactttgtttcaaagagtaacatttttgatacatcattgaaaaaagggagctacaggcgtacagagtttgttttaaactacatgaccaactgtgtgaccagccgccaagacaggatttgaacctgtacctcaagtctgtaaagacaagcgttcaaccgaatcgttaacagcgaagtatctctatactacggcatccctttctgttttttaaaagcagaagtaacaggcgaaaagagaaacggggcacgtcaatgccggagtcgaaccggatagtcttgctgattttacaacttcactattcctcccctaaaatgagacgaagtaactcttctctacgacattctgcttatgtcaaagtaaaaaacaaggtaacaaacgaaaagagactataccctgctctatccaactgagctatgcttttccttaaagaataaggagagcagcgggagtcgaacccgcgacctatggtcgtcccaaacgaagtaactcttctctacgacacttgttctgtttttttccgtaaaccggaatcctgagaactccggttataccactatcttttttatctcctgcaacgcatcatttcctttgtcgattgcagacaaaatatcaaatatcttatccgaccatcccgctatcagaaatacatcgtcacgagtgatatccagcggagtgttgccatatccgcttaagtcaaacagatacaacttggctgccggacaaattttcttgtacttcctccacaaatccgttatctgcaaatcactatggctattccacaactgacagtcggtgaacatcattatcttatccatctgcgccttccgatctatcaggtctttgataaccaaatatccgtttgtagagtatcccacttcaccttcccttttatagaaagcatcgacattggacaagatacccgtatcgggcagattaataatcttccatctatcgccaaagatacccgtcatcacctgcttgcaacgtgacttcaacaacattcccagcagcaaaccgatgtcatagtacaatactttactctttgccgaaaccggacactgcatggaaccggatacgtcacaggctatcagcacacgggtagattcatcaaatccggtaatattgcgggcagatacctgcacggcacgttccaaagccgtcatcaacatcgtagcatagagcgaaggagtcttcgacaactcacggtaagcagccaaaaagcggaaaggcaactgcctggagttttcaaccgccttttcggaagacagcctcttccctactgtcagaatatggtctgcagaaacttccgcttccagtatattcctcagattgcgcagcaaagccatgtatcctagtttaccactgtctatcaattcttcccatttggcacggaaagcttttcgccgttcttcttccgtagcaaaggtacgctgacctaaagcagacaattctgtctcccaagtatagggaaccggaagattatcgttaactattccattgaaaatttcctgttgccgttcatctttcgctttcgggtgcacaagaaacaaggcatctttcagacaaacttctgccgaacggttatacttggcaaactggtacgcatcgaatgtattgaatgcatcctgtagccctgcctgcaactgtttggaaagacggttcagtttctttgtccccgtccgccggtttgcctgctgataacaggccagcagttcggtgatttcatcggcacgccgaacggtacgggcagttacccgcttcaccagattgtcgccctggtggatacgcgccagttctaccgccatcaccaaagggatggaacgcaggttcatcgtttcccttgcgtacgccgccagttgcgccacaaacaaagggttacattttccgatgagcgtacggaccctttctattctctcttcctcctgctcatagaaactgttgttcaatgaagtagttaccacggatgtgtacaattcccattcgggtgtcagccggtaagccggtgccgattctttgttcagcactttattcattcctttatttatccagttaaacttcatcatttatactctttatttgttttcttttgcaaagatacgggggtgggtacgcagcctttttgcgtacctcaaattatttttctacttttggagaaaatctttatacttccgcctatgccggtcaatagaaatgccttgattcgttataaaacgattgataactgtctgcgtaatccttatcgtcgctggacactggaagacttggtagatgcctgctcggatgccctttacgaatatgaaggaatcgacaagggaatcagcaaacgtgccgtacaaatggatatacagatgatgcgcagcgagaagctgggttataacgcaccgattgtggtatacgaaaacaagtattacaagtacgaagacccggaatacagcatcacacaaaccctgctgaacgaacaggacctgaaaacgatgtcggaagccgtggaagttctgcggcagttcaagggtttctcctacttcacggagatgagtgagattgtgaaccggctggaagatcacgtagcctccgcccgaatgaagacgactccggtcatcgacttcgaaaagaacgaatctctgaaagggctggattatctggataccatttaccatgccatcgtcaacgaacatcccctgcaacttaaataccgttcgttcaaggcccgttcggcaaacagcttcatcttctatccttatctattaaaggaatatcgcaaccgttggttcgtatttggagtcagaaaaagcggacggatattgcagaatctggctctggacagaatccattcgttagaggtgttatcgcgggaaccctttataaagaatacattcttcgacccgaacacattctttgacgacttggtaggggtgaccaaaaactccggaagcaaagccgagaaggtcggttttaaagtagccgccaacgaagccccctacatcctgaccaaaccgatacaccacagccaacgaaccatagaaacattggaagacggaagtgtgattcttgaaatagaagtagtcatcaaccatgaactggaacgggtattcttcggatatgccaacggaatacaagttctttacccgcagacactggtggagctaatagaaaagaaattaaggagggcggtagaacaatacgaaaagcccaagtgagttacattcggataaaaagcaagtaaccggaccattttcatcctttccggagagaaaaagacattttatgatacaattaattccattttaatgaagaattaatttgctttatcctctctttttaatggttcgacctttactttgcccttgataataccgaaaaactcattaaattatgaatatgaagagaagtttaattttactatgcggtctgctgaccggctttaccttgcaatctacaaaggtaaacgcgcagacacaaacagtggctaatgaccagaaactggtctatccctacacctttgcccccagcgaaggtctggtgaaccaaacagaaaaggaacatcgacaagagatttgcatcaacggttattgggatttccagcctgtccgcttgccgaaagaatacgttcagggaaaaggtatcgctcccgaactacccctgccggaaaacgacagcgaatggagcaaaacacgtatcaaaatcccttcaccgtggaatatcaatgcttttgcttaccgcgacctggaaggtcccgaccaccgcaactacccttcataccccaaagaatgggaacaagtgaaaatggcatggatgaagaagaatgtcaccatccctgccgactggtcggggcaacaaatcaaacttcactttgaggccgtagccggatattctgaagtctacgtaaataaagaaaaggtaggcgagaacttcgatttgttcttaccgttcagctttgacatcaccgataaagtgactgccggcgaaaacatagagatactggtaggcgtacgaagccagtcgttattcgaaaacaatgcgaccatcggacgccgcattgttccgggcggatcgatgtgggggtatcagatcaacggtatctggcaggatgtatatctgttggctttgccgaaaatccatctggaagacgtatacgtaaaaccgctggtatcaaagaatacactggaaatagaagtaactcttcagaaccggacagagaagaagactgatgtacaactacaaggtaatatctgcgaatgggtgaactgcgcaggaacagacgtcaactccgctcccgttccgaactggacgcttggtaatgaagcattgaaagtcgctcctacgaaactgtccctgccagccaaggcttcacagaaagtgaccttgcaagtacctgtcgacaaggacatattaaaatactggactccggagcatcccaacctgtatgccctgttactttccgtcaataaccagaaacagactgtcgataccaaatacgaacgtttcggctggcgtgaatggacattgcaaggtactacacaatacctgaacggcgaaccttacgcattgcatggtgactcctggcattttatgggtatcccgcagatgacccgccgttatgcgtgggcctggttcaccgccattaaagggatgaatgccaacgcagtccgtccgcacgcgcaagtctatccccgcttctaccttgatatggctgatgaaatggggatctgcgtactgaatgaaacagccaactgggccagcgacggtggtccgaaactggactccgacctcttctgggaagcatccaaagaacatctgaaacgttttgtcctgcgcgacagaaatcacgcgtccgttttcggctggagtatcagcaacgaaaacaaacccgttatcctgcacgtttacaatcgccccgaactgatgccggtacaaaagaaggcatgggaagaatggcgtgacattgtacatcagtacgaccctacccgcccgtggatttcagcagacggggaagatgacggtgacggtatattgcccgtgaccgtaggccactacggagacatcaactccatgaaacgctggatcgaaatcggaaaaccttggggaatcggtgaacacagtatggcttattacggcaccccggaacaggttgccaaatataatggagaacgcgcttacgaatcacaggaaggccgtatggaagggctggctaacgaatgttacaacctcatcgtcaaccaaagacagatgggagcctcttacagcacagtcttcaatatggcatggtatgccttgaaaccgcttccactcggcaagaaagacaaaagcaaagctcccaccgttgaagctgacggagtcttcttcggtgattacaaagagggagttccgggcgtgcagcccgaacgggtaggcccttattgtacgacgttcaaccccggttacgacccgaccttgccgctctatcaggaatggccgatgtacagtgctctacgcgcagccaatgctccggggcaaccggcctggtctccttatgctgtaatcgacaaacaacagtacgatcatcgcaaaacaacaactccttccaaaaagtataaggaagtcatctttatcggtagtcagaacagtaaattaaagcagctgatggatgcgcaaggagtcatattcgccaagaaggcaaacactccttccctgttgctctatattgtagacggtagccaaaagttggatgcttctaccaaagatgagatgcaaaagcaaatcgccaaaggtgcggatgtatggatatggggactcacaccggaaacggtagccgcatacaatgaaattcttccgcttccggtgtccttggataatctgcagcgttcttctttcctgcccgtacaaaagtcatggatgcacggactcaataattccgacttctacttctgcgaacttcagaagaccaacgcttccagctactcgctgaaaggagctttcgtagaagaaggcgaggtcttgctgaacgcctgtaagaccgactggagaaagtggaacaaacgcccggaagagatcaagactgccggaacgatccgcagtgaatacgaatgtacagccgccactcctgtatttgtaaaatgccagcagaacgcttccactttctatctgaacacattaaccgaatttgccaactcggagaaggggttcaacactttgagcgctatcctgaagaatgccggaatagccttccaaaagccggaagtcaatatcgacgaggtcttcttcctgcgcgacgaacagatcaacttccccgtagccaccaaagagaaactggtgaaggacagcgacggtgaatggacactggaactttatgtattcagtccacgccctctggacgacctgttgatagagccgaacatgccgaaactatccctctttgtgaaagcaaagaaacgtgcgctgctcatcaacgacaaaccttatacggctgtatcccacgacggacgcaacgaaatcatctacaaagaattgcccttgctgcaaggatggaataaactggtgatcaaactaggagccggagaccggaacgacttcaccggctatttcaaatgcgataacaagaaagatttccttccgttgttgaaagcagctttcgtgaatccggaaaccaaataatagtaaataaatatatgatgaaacttacacacattttagcctcggcggctatcatttcaacgctgagcgcatgtaacggtagcctgcaaacagcggatcggacaccggtcgattacgtcaacccgtatatcggcaacatcagccatctgctggttcccacgttccccaccatccagttacccaacagtatgcttcgtgtttacccggaacgcgccgactacacctccgaactgctgaaggggcttccattgattgtcaccaatcaccgggaacgttccgcattcaatttcagtccctatcagggagaaaagctgcgtccggtcataacgtacaactatgacaacgagcacattactccttattctttcgatgtggaactggatgacaaccgtatgaaagcggaatatgcgctttcccaccagtcggctatctaccggataacgtacgaggcagacaaaccggcttacctcatcgtaaactcccgcaatggctctatccacgccaacgagaacttcatcagcggccgccagcaactaaatgacaacaccaatgtctatgtatatatagaagcacaggagaagccgataagcgccggcatcctcgaaaacggcactattgaaacaagtaaggataatgccgaaggcgcaaacgcctgcgcggcatggcgctttgccgatggaaccacaacggtcaacctccgctacggtatttcttttatcagcgaggaacaggccgaaaagaacctgcaccgcgaattaaaagactataacatcaaagcactggcagaagcaggacgccaaatctggaacgaaacgttgggacgtatccaagtagaaggaggaacggaagatgacaaaaccgtattctactcttctttctaccgtaccttcgaacgccctatctgcatgagcgaaggcggccgttacttcagcgccttcgacggaaaagtacacgaagacaacggtactcctttctacaccgacgactggatttgggacacttaccgtgccgcacatcctctccgcacactgatcgaccaacaaaaggaagaagacatcatcgcatcctacctgcgcatggcggaacaaatgggcaatatgtggatgcctactttccccgaagtaacaggtgacacacgccgtatgaactccaatcatgccgttgccacggtagccgacgcactggcaaaagggttgaaagtagacacggcaaaagcctacgaagcttgccggaaagggattgaagaaaagacgctcgccccgtggtcgggagcaccggccggctggctggacaatttctaccgtgaaaacggttatatccccgccctccgtgtggatgaaccggaaaacgacccgaacgtacatcctttcgagaagcgccagcctgtcgctgtcactctgggaaccagctacgaccagtggtgtctctcccgtatcgcccaagctctgaacaagaaggaagaggccgaatactatctgaaatgttcgtataactaccggaatctctacaataaagagaccgctttcttccatccgaaagataaggaaggacaatggattgaaccattcgactaccgttttcccggaggcatgggagcccgtgagtattatggagaaaacaacggctgggtttaccgctgggacgtgccacacaatgtagccgacctcatcagccttatgggaggaaacgagcagttcatcgccaaccttgaccgtactttcaccgaaccgctgggacggagcaaatatgcattctacgcgaaactgcccgaccacacgggtaatgtaggccaattctcgatggcgaacgaaccgtctttgcacgttccttatctttataactacgccggacagccgtggaaaacacagaagcgcatccgtcaaatgctgaaaacatggttccgcaatgacctgatgggtattccgggagatgaggacggcggaggtatgacttcatttgtggtcttctcctccctgggcttctaccctgtcactccgggattgccggcctacactatcggaagtccgcttttcacagatgcaaagattagactcagcaacggagctgtcttcgaaatcgaagctaagaacgcttccactgataacaaatacatccagtccgccacgctgaatggcaaagaatggaacaaatcatggttcagccatgatgacctgatgagcggtggcaagctagtattggtgatgggcaacaaacccaacaagacatgggccagcggagcagaggatgttcctccatcattagaaatcaagtagctatattctagcgattaagcgcaagaggtttgtcgaagaatcatcgaaataacatctgattcttcgacaatacctcttgtcatattcttcggacgacagctatcatatacgagtattccaacactttggttatataaaataagtccccgattcttatgaatatcatattgtttttcgtacttttgccacataggaacagattcaagtagaagtactatgaaatatcaactgcaattattgatttttatcctgctttgcctagcgggcagactggatgcgtctcctttatatgattacggactttatcttaagtctcatgccgtaccggcaccggaaaggtctactttatatttggatgacaaccaacctttctccgtaaaaaacgacttaaccatttcttttcatatatatatacgtgccaatgaagccgactatggctccattcttcatctgaagacagacaaaggccagataatacgcttttcgtttgttgcaggcgagcaaaaccatgctcccgctttaatgctcaatgatgagattatcatcattgacaaacccatagaactggaaaaatggatcaatgtctcgctgaatctacgccaaaaagacaatgtgatcgaaatagaatacgacaaaaaaaagatgtcgtccaccttccccctgcaagaaacaaacagtgtaacgattacattcggacagatgttaggctatcaggcggaagtagcccctgtcaacttaagggatatcaacatcatacaggacggcaaactgacaagagaatggaaattatggaaacataacgacaatctctgttatgacgaaaaagagggagccgttgcacgtgctgtccagcctctctggctgatagacaaccatatcgaatggaaaacaatcaataagatcacgacttccagcagagtaggcatagcattcgacgcccgttgcgccttattctatgtagtcagtcccgaatcggtgaaagtgctggacgaagacggaagactcaaacaagagactgccgtacgcggaggatatcctgccgtagaatatcccaaccacctactgtatgatacgctgagcaatgcactggtatcttactcgctgacagaaaacatcatctcccgcttttcgttcgccgacggcatgtggagcaacgaagtgcggaataccaaagagcccaacaactataaccatgccaaagcatttaatcccgccgactcctcattctactttttcggcggatatggcttctataaataccgtaatgacctgttccgcatgaagtccggcagcgaaattatggagcaaattaaatatgatcatccgctttatccccgctattcggctgctatggcagtagtgggcgacgaactatatatctttggaggcaaaggaaacaaatatggtaaacaggaattgagtacccactactacctcggcctgtatgccatcaatttaaaaagtaaacagtcccgcaccatctgggagaaaaaagacgataacaaggaaactatcatggcttcctccatgtacttcgagccggcagacagttctttctatgccgtatctacggacaacgggggaacactgtggaaaatttccatgaaaagccctgtttatacagaagtttcaaaaccgatcaataaccgactggattatcaggactgcgattttaacctttactattcaccgactcacaggaaactgttccttgtattggacaagatactgaacaatcgtacgcacgatattaagatctattccatcaatatgcctttagtcaacgagatagatatccggcagtcagtggatgaaatgggctccggcaaatggtggaatctgctgtatgtcatcggtgtcctggcaatactaggttgcggtgcctggttgttctatcgttcaagaagcaaacgtcagccaatccaatcgtccgcaatctcaaaagaaacacctcaatcggttacggctccaaaagctatctctgagaatcaagagaaagttactccgacaatgccggaacaagaaaacgagcccgcaccgaaagagatagtccactactacgatcgtagccgttcttccatctcattgctggggtgcttcaacgtacgcgataaagagggaaatgatatcaccgccaatttcactccccgtctgaagcacttgcttattttgctgatattatatacggaaaagaatccgaacggtatcctgacctccaaaacaacgggaatcctatggccggataaggaagagacggctgcccgcaacaaccgtaacgtaaatttacgcaaactgcgggtattactggagagtatcggtgatgtagaagtcgtgacggaaaacaacttcatgcacataaaatggggcgagaacgtattctgcgactatcgcgaagtacttgcacgcatccagcaattcaaggagaaagaaaacagcgagttactcaaccggatcctggaacttctgctgtatggaccattattgcccaacactattctcgattggttggatgacttcaaagaaacatactccagccactccatcgacttgttgaaggatctgtttgaaatcgaaaagcaacgcaaccatccagacatgattctccgcctggcagacatcatgttcctgcatgacccgctgaatgaagaagcattggccgccaaatgcgctgtattctccgcacagggaaagaaagggattgcacgaaatctgtatgaccgtttctgcaaggagtatcgggactcgatgggagaagattataaaacaccattcgccgatttataactgtatagctttacttctttcttcacagaaaggaacaaaacagcagtaacttcattctcctccttcgggaaggaggagtacccgtagggggaggtggtaggtgaatacacatggctgattattaagttgatgcgctcacctaccaccccggctttcagccacccctccttcccgaagggaggggaattgagatactatcgatttattcaaatctgaatcgggaatgagctaaactaaaccgtatggataggtaatcagatgtacgaaagaagcatggaggacttgacaaaccgctttttatgttgtatatttgtaagtagaaaccggaagaaaattcgataacattgataatatagacgaaaaatgagcgataataagtataatataataacaatatgaatatataatgaagcgaaccgttcgatataccgttcttgttttgattgctattataaattctttagttattactacttctctctatgctgttctgccttataatgaactacatcagttgaatatgagtaatggcttggtagataacatcattacttgtatctatcaggatcaagatcgttttatgtggtttggatccactaatgggctgagtcgatatgacgggaagcagattcgcaattttagtgtagacaatgcgaggatgtatgtttccgatataaaagagacttctgatgataaattgtgggtaataactaatgagtatttatattgttttgatcgacggaaagagaaatttgttcttccgtcttttcaggatgggaaaaaggccatttctgtaagtgctatggaaataacaggggattcacttttttggatagtgaaaggcggacaattgcaatgcttgaaacgacattataaattagtgaaaggtgacttacaaatagagatgactgtcgaagcaggctatccgttttttttagatgagggggaatctttttcgaatttatgtgcttcacaagacgggcatttcttgtatttggttaccgataagggaaatttgttgttctttgataagattgcaggtaaagtggtccggaagttcaaatactctattaatcctagcgctaatgctactactatcatgagtgaaggggaatatatttggatttcttctatagtgggtggagtaactcgtctgcatattcccacgggaaaatctgattattatcagtataatgaggatgccaggttgtcttctttatcacattcagatgcgtatggggtggttgcgttggataatgattcttacattgcagtaacctggaatggatatactctgttagctcctgaagaaaatgatccttctaagttgtcggcaacgccttatacgaatacctcatttttgcagtaccggaatgtagagacaagaatgatttctgtttattatgataaagagggaatactatggatcggaactagaggaggagggattgtctattttgattttagacagcattcttatatgcaatatcacagcaaaaaacataatgaaatctctgctcaggtggctgacaaagatggtcgaatttggttgggcacttaccatgaaggaattatgcgtagtgaccagccttatgctaaatcgcgaccgctgaacttttctcctgtgggcaatcaaaaagaagtcccggtgttttgtgcaaccaaagattcatgttctaatttatggtttggaaatgcttccggaaatttgatttgttatgactggagttccgattctttccatatatatccgctcaattatttaggaaaaaaggtaaattcctatatagtggccttaatgattgacacccgttatcggttttgggtatgcacttctgccggattgtacttatttgatcggcagacaggtcattttgaattattctcattgcgtgaagccttgaaagaagatgcagagccatgggtcactgctatttgtgaagataaacagcggaatatctggatagggacagcaaaaggtattgtacgattatcacaggtaaatgttcgtccattaaagatggttcatggatatgaagaaaaagaaaatataggagctcgtgtagttagtgctttactgactggtactgacggaactgtatatgtgggttataaaaatggatttggaatcattcctgtgggcgaagataggatagcgtctttttatacagtaaaagatggactttgtaatgattgtatagattgtatagtggaagatgagaagaagcgtatttggttggggagtatatccggtatctcaagatatagccgacagcaacatgttttctacaactattatatttctagtagcaataaatctgtgatgttgtttaagaatactttattttggggaaacaataagagcttaacttattttgaaccggaaatactgacatctgccaccattgccagcaaaactcttttaaccggattagaagtcgataataagccaattaatataggtgagaagataaaagggcaagttgttttggactcaaacattgcatcaattgaccatttggaactggtcaatgcaaaccgtgatttctctctccttttcaataatctggctttttcgaaggatctgcaaaaatatagctatcggttatatccatatcaaaaagattggattgtttctgaagcgggtaaggtctcgtttaccaacttgtctgccggttattatatttttgaagtcaaaacattgttccctaataatacggaaggagacgttactgcattgccgataacaatccttccacattggagccagaccgtttggtttcgtttgcttttgattttctcggttttatttttggttggttatattttctatagtttgttgcggcggcagcgtcgtttcaaaaaaatgattcaattgaaacatgaactgacgattgcaaatttggagagaaacgcagaacggcatatacgggaagaacgtgagaatttttttatgaatgctgctcatgagttaagaactcctcttactttgatactcgctcctatacatgatataatgaagtccattaccccatcggataattggtttgattcatttagcagattgcacaagaattgtctttctctacagacactggttgatcgtctgctatatgtacagaagatagagggcggtatgataaaacttcatctgtctgaatcggatataaaggagattgttagccgggtggctaatccttttctgcaaatggctatggtcaagaagcgggaatttttggtccaggtggatacagtgcctttgtatttatgggtggatgtggcgaaaatagaatcagctgttcaaaatttgctatcgaatgcctttaaatatacttctcagaatggacgtattgaactggctgtgtcagaggcggaaattgacggaaggccttattgccttgttacagtgtctgataatggggttgggatacctgatgatttgcaacagcacgtgtttgattcgtttgtaacaggaaaacgtatcccgcaatattccacatcaattggtcttggattacatattgtaaagcatacgatggggttgcatcatggatttgttacgttgaccagtcgtgttggagaaggcagccgatttgttctgcacattccggtgggactttctcattttgcgcagggggaatatgaaatggtacctgatccgatgaagggggatttgttagaagagtgtccggcagaagaacgtccgatggaagaagtagtagaggaaaagaatgagactatggaagaggccgttaacagagtgaaaaataataaggaatatttgttgatcatagaggatcacgatgagatgagagaatatttatgcagtctatttaaagaagattataatgttattgaggctgaaaatggagaagaaggggtggctatggctgataaatatatacctaaattaatcatatctgatataatgatgcctgttaaggatgggtttgaatgtagtcgggagattcgtgaaaataagcggacttttcatataccgattatctttttaacagctaaagcagaggatgctgaccggttgaaaagtttacaaataggggtagatgactatataatgaaaccttttaatccggagttattgaaagagaaggtgaaagcgttgatagagcaacgtgatctgctaagaaaactttatgcgaaaactcttatgttggatgaagaggtactggaatcttcagaagatgttcaggatgtttttatgcctaaaatgcttcagattatagaagaaaatttatcaaaccggaattttacaataaaagtgctgacggacaaattgaatatgagccagccgaccctttatcgcaaggttaagcagaaaacaggtttgtcgattatagaggtgattcatggagtacggatgagtaaagctgcctctattatcatgagcgggcgatatagcagtctgacagaagtggcggaaatggtagggtatgattcgatgatttccttccgtaagcagttcgttgcacagtttggggtgcttccttccaaatatatggaagagaaaatgaggaaataagaagccgcgttccatgttggcggcttctgtcttatctgtttgaatggttattgttaaaagcggaaagagacatggcccataacgtttgtacccgcttgcgcagcgtatccggcagaatttattctgtgattcacatccttgtcgtaagaactggatgcccaaccgttgttctcgtattcttcgttgaagaggttgtagacggtcacacccaaagttacttctttcaccacctttcggggtttgaatgtataggccagattcaggttgctcacaaagtatttatccagagtcaatgcttccacttccgcatttgtcatatattgcttgccgacaaactgggattgaagagctgcttcgaatccttgataggtaaaagcaaaacggttgttcagcaggaaatccggtgaaaaagcgatgcgggtgctcttatgagaaacgcttacgatgtccagtaggttccagccatcgtaaatgggaatgttttctacgaaattcttgatacggtttttgctccatgtcgcattgatatcccattggaaccatttacagggcttgatacctagcatcagttcgattcccatccggtaactgttcggaacgttttctgtcagggcttcaccgatatcgttcaaagctccggtgaggacaagctggtcggtataatccatgtagtagaaattggcgcctgccgtcagccaatgattggcgaatgtgtatccggcttcatagtcgagcagcttttctgctttcggataactgtcgggattgccatccgtataattatttcttgtcggctctttttgagctacggagaaagaagcgtagacacggtgattggagttgatattccagttcagtccgactttcggattgaaaaaatcgaatttcttgtctacggccagcggacgcaacgcatttttattccagtcgtatttgtcatttgctccgtcgatggtgtagtcgatgtgccggtattgcaggtcggcataggcacttagtcctccggtgaggtcgtagcttgctttcagatagatgttaccgtcggttttcttcgattggttgcggtagtattcatggtcgggagatagtgcgccgatgtagttctttacccaggtcactttcccgaagttattaccccggtattggttgatgcctccgcccaaagatgccgttagtcggtggttggtataattgagggagaaaacacccccgccaaacttattatccattttcttctgacggaccagatcgctttccgaaatttcttttccgtctgttgtaaaaggtttcagaccgtattctaggaaagatctgtcttctttatattcctcatagtagccgtcacctttggtgtagtgcagggctacgttcagattccacgcagtggagaaagtatggttgaaaaggagttgataattcttttgcagatagttatccgtctggtcggcataataatgtttttcattatcgtctccggtatattcgccgcaagggttataccgtcttccgtgttcttccatttctgctttagtagcatatccccaggcatgatacgtcttttcttttcctgcgaatgcgatcagtttgacagacgtattttcggcgaaatatcctccttgcagatagtaagagttgagattgacggaggcgcggtcgatgtatccgtccgtaccgatgttggaaagtcgggcatcgaatgtccagtgattgttcagcagtccggttcccacttttacagtttccttgtgggtgttgaaagaaccataggaaccgttgaactcggcatacggtttcatggacgcgccttcggtctgcatattgacactggctccgaaggcaccggcgccgttggtcgatgttcctgcgccacgttgcacttgcatatcctttacggaagaagagaagtcgggcatatttacccagaacagattgtggctttcggcatcgttcatcgggatgccgtttacagtgatattgatacgcgtgccgtcagtgcctcgtacacgaagagtcgtatagccgatgcccgatcccgcatccgatgtggtcagcgtggaaggagtcatgctcagcaggtagggaatatcctgcccgaagttcacttttttaagttcggctttgcctatattggtaaatgctacgggagtttttgctgtagcacgtgtggatactacctgcacttcttgcaggttgattactttcagactatcctttgcactcgtttgtgcatggacagggaagcctgcgcccaataaggcgacggccatcatcatcatttttttcatcttgcttattaattagttctctacgccggcattacccggttcagattctatgggtatgttctcagcccgtcatgttaaggcacccctacttagtgaatcgttggcaaaattactgcttttgcgggaggaaagcaaaaaaaacttttagatttgctaaaaacaatataactttgtagtttgttgaaatatgacaagtcagctatttattcattttaatataattatcaaattatgctactattatttcaagcgacagcaacacagcttgcggattctacacaaatcgtcgcagataaattaatggaagaagcgatagccaatgcggacggattggataagctttctctgatcacccagcaattggtagatttcggtatccgtgccggagaacgcatcctgattgcaacccttgtcttcattgtcggacgcttcctcatctcgatgctcaaccgatttgtcggacgtctgatggacaggagaaaggtggatataagcatcaagacttttgtgaagagtctggtaaatattctgctgaccattctgttgattatctccgtagtcggtgctctgggagtcgaaacaacttcttttgcagccctgttggcttctgccggtgtggctgtcggtatggcgttgtccggtaacttgcagaactttgccggcggactgatcgtattgcttttcaagccttataaggtaggagattggattgaaagtcagggagtttccggaacggtcaaggaaatacagatatttcacaccattctgactaccggagataataaagtgatttatataccgaacggtgcaatgagcagcggagtggtgacaaactataatacacagacaacgcgccgtgtagaatggattgttggcgtggattatggagaagattataataaggtacagcagattgtccgtgatatactgacggccgacaatcgtattctgactgatcccgccccgtttattgcccttcatgcgctggatgccagcagtgtgaatgtggtagcccgtgtgtgggtgaatacggcagattactggggagtttattttgatataaacaagactatttatgaaacctttaatgaaaaaggcatcaacttcccgttcccgcaacttaccgtgcatcagggaaactgatcactataagatatatactaaaacgagagagtttcacttcggtgagactctctcgttttatatgaacaaattgtctggtgtgattggaaaatttcttttttatttgatgccgaagtcttctgcaaactcatatcggtcttctttgatccccagtacatggttgattttccttcttttttcaaggtccttaaagtagctttctactacctgatagagatcaaaattactggttgatcctgcggcaagatcgagtgactccaccattttctctactgcctggtggattttccctgcgtctatcagatgcagttcgttgctgtgtattaaatatttctccataactgcaatgttttaatgttatattgttataacgtatcatagtgatggaaagttcaatccccgaatcttcattgcgtcttgttgtcaatcacattttaacagacaaataggttagaatctaatgtcagattttggcgagtgcctgttccagatcggctatcaggtcattgatatgttccgttccgatggatagacgtacagtgcccggataaatctcctgttctgcaagttcctgcgcattaagttgcgagtgtgtggtacttgccggatggatgactagtgatttcacgtcagctacattggccagcaacgagaaaatctccagactgtcgatgaagcggtgtgcttcttcctgtcctccttttacttcaaacgtaaagatggagcctgcaccattcgggaaatagcgttgatagagtgcatgatccggatgatcggagagtgacggatgattgactttcttcaccttcggatgattattcaggaagttcaccacttttagcgcgttttctacatgacgttctacacgcaaagaaagtgtttccagcccttgcagcaggatgaaggcattgaacggactgatcgttgctcccgtatcccgtagcaaagtggcacgaatgcgggtgacgtaagcagccggaccggcagcgtctacaaagcgtactccgtggtaactcggatcgggctctgtcaactgcgggaatttacccgaagctacccagtcgaatttaccggagtcaacgattactcctcccaaggaactgccatgaccgccaatgaatttggtggcggagtgtaccacaatgtctgctccgtgttcgatggggcggattaagtagggagtgccgaacgtattgtctataatcaaaggtattttgtgacggtgagcaatttcggataccgcttctatgtctataatattggaattcgggtttccgagtgtttcgataaatacggctttggtgttctcctgaatcgctttctcaaagttggaaaggtcgctcggatcaacgaaagtggtggtaacgccataattgggcaaagtatgtgccagtaagttatagcttcctccgtaaattgttttggcagctacgatgtggtcgcctgcacgagtaatgttttcgaaagcataagtaatagcggcggcaccggaggcaactgccagacctgctacgcctccttcgaggacggctacacgttcttcaaaaactccttgggtggagttggtcaggcggccgtagatattgcccggatcttgcaaaccgaaacgtgcggctgcatgagcggaattgtggaatacataagaagtggtctgataaataggtactgcgcgtgcgtctgttgccggatctgcttgttcctgtcctacatgaacctgtaatgtctcaaagtgtaaattctttctttccataatcgtatgctttttaagtttgatattctctctttattttcttgcaaagttatgggatgtagatatatcgaacaatatatagtgtaaatatagaaaataatgctatttttgtatcgttatacagaataaagcaactgctttattcttaaaaatcacctgttagaagaatatttttcttatggatacttttgagaaattagataaagtggatttgcagatactccgtactttgcaagagaatgcgcggttgacgaccaaagagttggctgcgcgggtcagtctttcatcgactcctgttttcgagcgccttaaacgtttggagagtgggggatatataaagaagtatatcgctgtgctggatgccgaaaagctgaatcagggttttgtggtcttttgcagtgtcaagctaaggcggctgaacagggacattgcggctgagtttacccgaatcatacaggacattcccgaagtgaccgaatgttataatatatcgggcagttacgattacttgctgaagatccatgctcctaatatgaaatattatcaggagtttattctgaatgtattgggaaccatcgatagcctgggttcgctggaaagtacgtttgtgatggcggaagtgaagcaccgatatggaatacatatttagtgggaagattgatgtatttcctatttttgctactccttgttttcgactcaggtttccggtggattgccgataatgtctctgtataagctgccgtcatggtccttgtattttgcgtattggtagaggcggaccagtatatcactgtaatcaagaatggctgtatttgatttctgtgataaattggtgcccaggatgccactgcctatgataccgggattatataatacggtgtcttgtctgatagagctcattatcagttctgcacaaatatagtctttaatccttgcctcttctagtcgggtcgtgatatatgagttcagatggcttttgtcatgttgagtcataaagccgtaccatagtaaacacttcattcctaactgggtagcctctattaatatatccagataggttaatcccgatgctcctttcttatctatctcataaggatcgatatgaatgaaagaatctttggggagtgatggcagtaacttcatgactccttcgagagaatcggtattatataggcggacggatgtctgtagttccgcttgcttcgcatagcgttccacattgtccaaagcactcttttctatatcgaagaatagaaatttttgtgcctgtcttcctaatacctccattgctaaagccggagaacctaaatagtaccctctctgcatttctgcattttctatcttatagtaaatggagtcttttagaacttgattgtcttcctctaccgctttttctaagaaatagtaaatgccatattgctgttccgaagtctgctgcatcgggtagatggcacaggcagaatttgtttctacatagacttgtggatgctcgttccgaagaacttcgcaaagtatcagatgtttcagtacatccggctgtttgccgaaatgagtataagttgccatgatgctaaaggtttatagtgacgatataaatggtatacagcaaatatacgggataatttttagatccttgcatctgatttccaaaattatcctgtacatttgttatgtgatatgaaccttattttttgaacgcaatgaaatggcaacgttgtaaatagcttcgctctatatggatgatggacaatggtgaaatctgttgttcgagtcttatgtggctaaacaggtcacccgatattttattattttatttcagaaactatataaagaagcaattacaatgaatacaaatatttatccgcgcaccaatgaccttcagaccgtctatctgaatgcagttatcaataatcctcatataaaggttggtgactacaccatatacaatgattttgtgaatgatcctgttcagtttgagaagaacaatgttttatatcattatcctgtcaatggagaccggctgatcatagggaaattctgttcgatagcctgtggagctaagtttcttttcaacagcgcgaatcatacgttgaattctttgtcgaattatccgtttcctatattttttgaggagtggcagttggataagggaaatatcacttcggcatgggataataaaggggatatagtgattggaaacgatgtatggattggttatgaggctgttgtcatggcgggtgtacatatcggcgacggagcgattattgcgtcgagggcagtagtcaccaaagatgtacctccttatacgatagtaggcggaacgccggcccaagaaatacgaaagcgttttgacgaaagtacaattgcacaattgcaggaattgcagtggtgggactggcctgttgagaagatatccaaagttttgctatctatcatgcatggaagagtcgatattctaatgaaattttaatccactattactgtgagttgcatgacacccgggtgttggtatgtctgacacccgggtctcatacatgctgacacccgggtctcagattactctctgtcgcatttgaaaaaaaattagcgaaagtctttcaactcttcctgcaattttttgcggatgaagaagatacggctctttacagtacctagtggcaagtgtagcttatctgcaatttcacggtacttgaatcctgcaaggtgcatagcgaacggaattttgtattctttggcaagagcattgactacacggtgcatttctttgaggtcataggcattttctgtactttcaaaacctgcatcttgtggtaaattcagatggtagaggttgtctgtatgatcgacaaaagtctgattgcgaatcactttgcggtagttattgataaaaacattgcgcataatggtgtacatccatcctctaaaattcgtatcagatatatacttgtcttcattgtacaatgcttttaaagacgtttcctgcaataagtcgtttgcttcatcaatatccattgtaagtttgtaagcgaaacggagtaactcatcctgtgcttctactaattcttttctaaaggtgaaattcttcatgttgattgtttttaagtttgataaatttgtttgttttgacagtgcaagtatatgtgatttctatgagcccgatagtggggaaattgacataaaaccaccgttaaattgttagataggaggcttctgacaatttaacggtggtttttgatagttttggggtggtgctcagacagctaatataccggagaaaacaaccggaaacacgcttcgcgaaatttaaccgaacggttgcgttggagccagtcgcgtagatttagttctttactattattcatatcggtgtgataaatgtctctgacggtctgagcaactttcttgtcgtaaatgaacagattggtctcgaaaagaagttcaaggcttcttatatccatattggctgaaccgactaccaccagttcatcatcgacaatcatcaactttgaatgtgtaaatccattgacatattgatagactctgactttatttcttaatagtttctccacatatgagttagaggcatattgcacaaaatcattgtctgatcttttaggcatgacaaggcgaacgtctattccgctcattgatgcggtctgtattgcctgaagcagacattccgtcggtatgaagtagggagtctcgatatatacattctttttcgcccgcgttatagctgtaaacatggcttccattacattggaatgcattcccaacggttccgcgttgactacttgaattggtacttctccgaagacttcgacattgggataatactccggtgaagacagatattgtccggaagcataataccagtctgccagaaacacagattgcagccccgaagctccggaaccttcaaccttgaagtgtatgtcattccattttccccagagaagtccgtctatgtatacgtcttttacattgatgccaccggtataggcgattctgccgtcgatgatgactatctttttatgattgcggtaattgacacttcgcaggaagcggggaaaactaagcgggaggaacgttttcacttccacgcctgcttctatcatttgcttgaaatattttctgttcgttttattgcatcccagtccgtcgtaaagcagtcgtactttgatgccttgttttaccttattgataatcttctcttttaattcgttgccgatatggtcgtcgccaatagcataatagaagatatgaatatgcgattcggcacagtcgatatcttcgaaaagactgtaaaacttacttttaccacccggatagacagttactttgttacctccgaatactggtgactgttccagattcaatatgagtgattttagttctttataatgatcgggatgtattggctctgtttccacgttggtagaaacggattgttggtgcctgttgaattcttctctccaaaactgaaattttgaacgctttttgcttacattacgtcctacaatataataggcagatatacccagtaatggtaagaatataacaactagaatccagcagatcgtcttcacaggatttttgtcgtcgtaatcaattataatagtgtaaatcagccctaataggaatgcgatatacgctaacaatgtacaataccatatccacctcatagcaactttgttttttttgttttgatgtatgctttacttatgaataaaacaatgtgttagtatctgttgtttgttggcgattgaaaaaaagtaaaacatccccttgatatttattagaacagaagttatatctttgtcctcaaacaatatatgtatgaattttataattgaacccggttctttggctgatatagatgaattagagaggctgtatgatgaattgaacgatcacttgtcagctacaatcaattatccgggatggataaaggggatttatccggttcgtgagaatgcggctgccggtgtggatgataatagtctgtttgttgcccgatgtgacgggaggattgcgggttctgtcattttagatcatcagccggaaaaggcttatgagaatatagtatggaaaatagatgcggattatagttatatttttgtggtacgcacttttgttgtacatccatcttttttgcaaatgggagttggacatgcattgatggatttttcactggagttggctttaaaatcagaaatgaaatctatccgactcgatgtatatgagaagaatcttccggctatttcgttgtacgaaaaatgtgggttcgagtatattgacactgtggacttaggactgggacattatgggctggattggttcaagttgtacgagaaggttatttgaaccgtaaataatataaagtggaggaagctctgacaaaattcatagttcatcaatcatgttggagcttccttcttattataaaagtagttcaagcatttatttatttccgaagatttaaataatgctctttttcatttcaaaaacaatatccttgatacatacattttctgatagattcagtaaacatcggattgtatttaataaatcatcaggttgtatcatttcttcatctttaaaaggtgttcctgcttttttcgccatatcagtattcacccagccagggcaaagagtagtgacacgtatgcctaatggtgctaactcacggtatagagattcagccagcccgaggagtgcgaatttggtagaaccataaatacctccatcggcgaaaccatatttagcggcgcgagatgcgacattaaatatatatccgtttttctgtactttcattatctccgtcaccgttttcagtattccatattgagcaatgacatttatttccattatcttcctgaaattatcaacaggttcgctaagagagccgtccataaacatggcagctgcattcaccaagatatcgacagcaccatatttttgatggatgtctttgatttcagtatctgcctttgtacaatctgtaatgtccaatggtagtacaataggttcttgtacatgtttgttcgatcgcatgatttcatcatgtactttctctaagttctgtttgcttcgggctatcaataccacccgataaccatcagttgccaaacctgctgcaatgacagcaccaataccttgacttgctcctgtaataatagctaatcctttttgcttttccataacctgaaattaaaatgagtttataaattatgatgtaagaaatacagagacggtataggggtaaaaaaagaagcctcggagtattccaaggcttcttacttattatatatttttgcacattctgtttgatatattcggcgcagatgtagcagcaggcaaggctgattcttttgaattttgccctttccctataaatatgccggaatatagggaaatcaaaaacgtctatatgatcagattgttccattgattatgatttcatgtgcaaaagtaggtatatcttgttgaatgagaaagtatttcatcccgaaaataatgaaggttatctatttaaatacttattaatacatctccggtcccaatttatccctcgcttgacaattttggccggaatgcctgcaatgattacattcggttcgttaaactcttttgttacgatacttccccagccaacgatactattatcggctattatcacattcttgccaatttttacgcctatctccttttacgattagcagaaacgttgctaagcagcaattcttccgcactttcttcagtgtcgaaatacattgagatacgattgttgtttcctgtgattgtgatgttggcctgattaataatcttattgaatttgtcattcccatatcttttctgtgctgctttgatttactccgttgcccgatatttgttcgttcctgcaccgttatgaactagttccgagtttacgtagatttactttttatgcttaatggatgtaagattaatgctgcaatgttttattcgtctgacagttgttagacgaaagttcaacagttgtcagacgaataaggttatataaaccgagcactagatgattgcatacagcaaattaattttaagagagactgggattagttcgttacgacgcgtttcagtgagttgttatttaccgtttgaaatatttatttctctctgtgattacatatttccgcttgatttctcttttattatatgtaattttgtaactctgaattaagaatgctctatatgaaactaaaagttttgacaacaaatcattgtgtatacaaaataaatatccggtgaatcactatgtgcagaataatcatcttattaatttcattgatactatcagtgcaatgtttttcacaaacggagtttactacttgtctgtttgacatatccagaaacagagtgataccgatagcggtttatcagccgcagaaagtaaattcaaaaacgaaagttatcatattcagccacggctatgatgggaataaaaacagtaagtcgaaccaaacctattcctacctgacacgttttttttcacaaaaaagtttttatgtgattagtatacaacatgaattgtccgatgatcctcttttagcgatggaaggcgatttcatgcagacccgtatgccgaattgggaacgaggaactgacaatatactttttacaattcaggaatttaaaaacttgaaaccacaattgaattggagcgaactcatcttgatagggcattctaatggaggtgatatgacaatgctgtttgccactaaatacccgcagctgatcagtaaggctgtatctatggaccatcgtagaatgatcatgcccagaactttgaagccacgtttgtatacattgagaggatgtgactatgaggcagatgcgggagtgctacctaccggacaggagcaggagcacttcagaatgaaagtagtaaaactggatggagttacacatagcagtatgggtgagaatggaacggcagaacagcatgacctcatcaatcaatatatctataaatttctgacagaaagataactgaagtatcatttctattttatccggtggttttaaaccggaagcctgtttttcttgtatgcttgctttgttattataaataaaaacagacgaatatcttggttggatgtgaatagtgattgttatatctttataacgtactaattcttcttacaaaagtttaaatatgtctttaatagtaactgcatatacacaggaaggtattgtaataggtgccgatagttgtattacaacaaatttcacacaagaaggaaaagaactatataaacatagccattgtgggaataaactattcttgttaaataagaaaattggaatatcaacttgcggtgatgcgataattaatggtattcttctaagttctttaatcgaccaatatatatggtctaaaaaagaggaaaatataactttacttcaagttgaaattgatttaaaaaatatagtcaacaatcaagccaaaggcaaagagtattatgttatatttcatatatgcggatatgaaaacgggaaaagatatgtttctaaatttgacaataacgataaagaaagccatatcaaagatgtttctgaacgtgacggctgtatttatgatgggcaagtagatattgttgacctgttttcgcaagatgtggcatataggggaacagatggtttatattatgatatcaacatagaaagatgtaggtataacgaactttcattgcaggaaacaattgaatatgtctattttcttatcagtacgactattcagcacatgagatttacctataaaaaggataatgtaggattcccgattgatattcttgttataatgccaaacgagtcgctatggttgcaaaagaaagaactacatatacctggcaattattgattcatccgactggtttcactgcgagattgctcgcaactgatccgaaaatcatctttttttgatttttgggatatactagttttcatttgaaataaaacaccaatatctccttctaaggataatctaaggagttcaatagggttaaaagttggaattgcgtcattggaatagcaatattcaaaaagaatttctccatccttatttttgatggaaacttttgtattagatgaagactgctctgaatagatgtgaagttcttgtaatagcatagtgttttatcttaatatataatatatggaagaaaaagacaaaataatcgcatcactccggcaacaactccggaaagtcctgcgagaaaacagagttcaaaagcaagaaattgctctcttaaatcatgagttagaaagggctaaaatgaagcccccaaaagagcgttctttgaactatctttgaaatggttagctcgcatcattataattgactgatatgtagctgaatatcctttattatcacgccgctttgggagcagggggtcgtgggttcgaatcccgctaccccgacgaaaaaaaagagttacattaagtagctcttttttttgtttatgcaaaaatattatttcaaatgcaaatagtattcacgagtcaattctttatactcttcactatattgatgacgggctacttcagtcaacagttcctccttaatacatccctcattattaaacgtaaaagtaattaacatccgtttaggagttcctcccggcttggttattacatttagctggcgagttgcatataaatgatattcggaagctgcagtcttcaccctgtcagccacgtctgtcggtattacgattgtaaaagtaccctctttcttcaataaatcagccacacccttcagcaacttttcataagtcagagaatcgttatgtcgtgccatgcttctctgttggtccggacaactaagcgaatccacaaagtaaggaggattggaaacgatcacatcaaatttatccggagactgatagaacagaaaatcttgcttcaccacttctatccgatccttccagggagaacgggccacattttccttagcctgcccggcagcggcttcgtcaatttccagcgccacaatatttgcatccggcagactacgttgagccagcatcaaagcaaccaaccccgtcccggttccaatatctaaaattcgatgtgccccttgaacagaagcccacgcccctaaaagtaccccatccgtacctaccttcatggcacatttgtcatgccatactgtaaactgcttaaactgaaagaaaggattcgccatcttattagccatctaaacctgttttttactgatctttgccgaaaaccgtcaaaaataaataattattatggaataaatccattaacgcccgatattttggcattgtttttgtgtttttattccacactgtgctttattattaaagagaatcaattaactttgcaaacgatttatgcatattatgtatgacataaactaaattaaaacgaaaagatgaaagaaagatacttattggaagaagaagttggtgagaacggcttctcactgattaccgactatgatggcaatgacgaacatgtgtttgatgtgaatataaaatccggtgatattcttccggttctcccccttcgtaatatggtgttgtttcccggagtatttttacctattacagtaggcagaaaggcttcattaaagctggttcgcgaagctgaaaagaaacacaaagatattgcagtgatttgccagagatcggcacacacggaagaccccaaactggaagatttgcacaatgtcggcactgtcggacgaattgtacgggtactggaaatgcctgaccagacaacaacagtcatccttcagggaatgaaacgtctgcgtctgaaagatattgtagatacacacccttatctgaagggcgaggtcgaacttttggaagaagatgtcccaaacaaagacgataaagagtttcaagccctggttgaaacatgcaaggacttgacgatgcgttatatcaaatcatcagaaatgcatcaggactcgtcatttgctataaaaaacatcagtaatccgatgttcctcattaatttcatttgtgccaacctgccattcaagaaagatgagaagatggatttattaagtatcaactcattaagagagcgtacttatcatctattggaaatcttgaatcgcgaagtacagctggcagaaatcaaggcatccatccaaatgcgtgcccgtgaggatatcgatcagcaacagcgtgaatacttcctccaacaacagatcaaaacgatccaggatgaactgggtggcagcggtcaggagcaggaaattgaagaaatgcgcctgaaagcagttaaaatgcactggaatgcagaagtaagagatactttcctgaaggaactggcgaaactggaacgtacacatccgcaatcaccggacttcagcgtacaactcaactatctgcaaacaatgctcaacctgccttggggtgtttatacaacagacaatctgaatttgaaaaatgcagaaaagacgttgaataaagaccactacggactggaaaaagtaaaagaacgtattctggaacaccttgccgtattaaaactgaaaggcgatatgaaatcacctattatctgtttgtacggccctccgggagttggtaaaacatccctcggaaaatccatcgcatcggcactgaaacgaaaatatgtccgtatgtctttgggtggtgtgcacgatgaagcagaaattcgcggtcaccgcaaaacttatattggcgctatgcccggacgaatcatcaagagtctgattaaggcaggagcctctaatcctgtatttatactggatgagatcgacaaagtcagtgccgaccgtcaaggcgatccgtcatcagctttgctggaagtacttgatccggaacagaatacctctttccatgataacttcctggatgtagattatgacctttccaaagtactgttcattgcaaccgccaataatctgaatacgatccccggcccgttgctcgaccgtatggagctgattgaagtcagcggatacatcacggaagaaaaagttgaaattgcccgtaagcacctgttgccgaaagaactggaagcaaacggacttaaaaagacggatatcaagattccgaaagatactttggaagcgattatcgaatcatatacccgtgaaagcggcgtccgtgaactggaaaagaaaatcggcaagattctccgcaaatctgcccgtcaatatgcaacagacggttatttcgccaaatcagaaattaaaccgactgatttgtatgaattcctgggagcaccggagtatactcgtgacaaatatcagggaaatgactatgcaggcgtagtcaccggactggcatggactgccgtcggcggtgaaatactctttgtagaaacgagtctgagccgtggtaaaggtgcgcgtcttacactaacaggtaatttgggagatgtaatgaaagaatcagctatgctggcactcgaatacatcaaagcacatgcttccatcctcgatctgaatgaagacatctttgacaactggaatatacatatccatgtccccgaaggtgctattccgaaagatggaccgtcggcaggtattactatggctacttctttagcttctgccctcacccaaagaaaggtaaaagcaaaccttgccatgacgggagaaatcactctccgtggcaaagtgcttcctgtcggtggtatcaaagagaagattcttgccgccaaacgtgccggaatcaaagaaatcatcatgagtgccgaaaataaaaagaacatagatgaaattcaggacatatatttaaaaggactgcaattccactatgtaaacgacattaaagaagtattcgcaatcgccttgacaaacgagaaagttgcggatgccattgatttatctgtaaagaaacccagccaggaatgacatttgagttacaatatacagacactaaaagtaatgcccgtgcaggtctgataacaacagaccacgggcagatacaaacacctatcttcatgcctgtgggaacactgggcactgttaaaggagtacatgtaacagaactgaaagaagatatccaggcacagattattctgggcaacacctatcatttatacttgcgtccgggactagacgtaattgaaaaggcaggcggactgcatcgcttcaatggttttgatcgtcctatgctgaccgatagcggtggttttcaggtattctcattagcaggaatacgaaaacttcgggaagaaggagccgaattccgctcgcacattgatggcagcaaacatatctttaccccggaaaaggtgatggatatagaacgtaccattggcgctgatatcatgatggcttttgacgaatgtcctccgggagattcagattatgcatatgccaaaaagtcattagggctgacacacagatggcttgatcgttgtattcagcgttttaacgaaactgaaccgaaatacggctacaaccagtctctcttccccatcgtgcaaggatgtgtttatcaggatttgcgtaagcaatccgctgaattcgtcgcctccaaaggagcggatggaaatgcaatcggtggactggccgtaggcgaaccggtagataagatgtacgagatgatagaggttgtcaacgagattcttcccaaagacaagccccgctatctgatgggagtcggtacccccgtaaatatccttgaaggcattgaacgcggagtcgatatgttcgactgtgttatgcctacccgaaacggacgaaatggcatgctgtttaccaaagacggtatcatcaatatgcgaaacaagaaatgggaaacagacttctctcccatcgaggcagacggtgcttctgctgtagacacgttatacagcaaagcgtacttgcgtcaccttttccacgcacaagaactactggcaatgcaaattgcttctatacacaatctggcattttacctgtggctggtaggtgaagcccggaaacatatcattgccggagatttctctacctggaagccgatgatggtaaaaagagtgtcaacaagattataaagaatgaaaagcaatcgattaataaaacggctggattggtatatcatcaagaaattcttggggacatacgtatttgccattgcattgattatctcaattgcggtggtattcgacttcaacgagaagatggacaagctgatggagcatgaagccccttgggacaagatcatctttgaatactacatgaacttcatcccctacttctccaatctgttcagtccgctgttcgtattcatcgccgttatcttctttacctccaaactggcggagaactctgagatcattgccatgttctccaccggtatgagtttcaaaagaatgatgcgcccctatatgatctctgccgccatcattgctgcggcaacattcatgatgagttcgttcatcattcccaaaggtagtgttacccgtctgaactttgaagataaatacatcaaacccaagaaagtcaactcggtccgaaacgtgcagttggaagtggacagtggtgtcatagcctatatcgataattacaatgacggaatgaaaaccggcaaccgcttttcattggataagtttgtcgacaagaaacttgtctcccacttaacggcacgccgtatcacttacgatacaacaacggtcaataaatggaccattcacgactatatggtacgtgaactggacggactaaaagaaaagatcaccaaaggagaccggatcgactctattataaatatggacccatcggacttcctgatcatgaagaatcaacaggagatgctgaccagtccggaactgagcgaatatatagaaaagcagaaacgacggggatttgccaatatcaaagagtttgaaattgagtaccacaaacgaattgcaatgtcatttgcttcgtttattctgacaatcatcggggtttctctttcatcacgaaaaacgaagggtggtatgggacttcatctgggtattggattagggcttagcttctcttatatcctgttccagacaatcacttctacctttgccataaacggtaacgtgcctcctgcgattgcagtctggattcccaatatcctctatgcaggcatcgcattctatctgtatcagaaagcacctaaataaggaaacataaaacttagatcaaggagatctaaaatagaagttccgcctattcttgccgaaagcaagtacaggcggaacttttttgttgtatccatttcctcttttgtctattctccattttaatcaccaaatgggtgattcggaaaatccctctttctccttactcttttcgagattgtcaaccaatctcacttacataagcagaaagatctgcagcagagatgtttttggctataatcacaccatttccatccaataaatagtttgtgaacccccgattcaaacggtactttttaaataatctggagtcctcgccttctgtttccacgaaacaagtgggcgtaactatttggtccttacgaacggtttccttaaagattgactggtattcgtcaaacgaaacagaaaccatttccacattacgggaagaacgaagcacattgctcaaacttacgttttgcatccgggattgcgcgtcataacttgcccaaaaactaagcaacacatatttacctttcaaattacccaacttaaaagccggttgcccattcgacgcagattcgattttaaaatcaggggctacgtcaccctcactcaaacctccggtaggtttgtctttctcaacgaaagcggtcaaggaacaaatcagtaatacaacaaaaatccattttacataagaattcatgtaatgcggttttagttaatactatccgggactgtccttaaacagtggtttcttcccgaaacgttgtcttttcaggcatcaggcgaagaggaatccgctgattatcagtgcctttaattttgaaaccgggtgcaaaggtaagtaattattaaattaacttccaaaaaaacaagccattttcttacttttggggtataactttttatgttatttagcataaaaacgaacttttttccctacttttgcagcgttaaagtctatttttttatgcaaccatcaaatactgaattgattctgattcgagttaccggcgaagatcgcccgggacttaccgcttccgtaactgaaatacttgccaagtatgacgctactatccttgatatcggacaggcggacatccataatactttgtcgttaggcatccttttcagaagcgaagaaaggcattccggattcattatgaaggagctgctgtttaaggcatcttcattgggagtaaccattcgtttcgaaccgataggaaccgatcagtatgagaactgggtaggtatgcaggggaaaaaccgctatatactgacggtattgggccgcaaactgtccgctcgccagatctctgccgctacccgcgtactagcagaacaagacttaaacattgatgccatcaaacgtctgacggggcgtatccctttggatgaggacaaaacggatacccgtacccgtgcctgtatcgagttctccgtacgcggtaccccgaaagaccgtatcgccatgcaggagcgactgatgcagctggctagcgaacaggagatggacttttctttccagcaagataatatgtaccgccgtatgcgtcgtctgatctgtttcgatatggattctaccttgatcgaaactgaggtaatcgacgagctggctatccgtgcaggtgtaggtgatgaagtaaaggccattacagaaagcgccatgcgtggagaaatagactttacagaaagcttcacacgtcgtgtagccttgttaaaaggactggatgaatcagtcatgcaggaaatagcagaaagccttcctattacggaaggagtagaccgcctgatgtatgtactgaaaaaatatggatacaaaattgctattctttccggaggattcacctatttcggtcagtatctgcaaaagaaatacggcatagattacgtatatgcgaacgaattggaaattgtagacggcaaattaaccggacgctatctgggagacgtagtagacggcaaacgaaaagccgaactcctccgtctgatcgctcaggtagagaaggttgatattgctcagacgatagccgttggagacggtgccaacgaccttcctatgctgggaatcgccggactgggaatcgccttccacgcaaagcccaaagtagtggcaaatgccaaacaatccatcaataccatcgggcttgacggagtgctctatttcctgggattcaaagattcttatttgaatatgtaattgagaccaaaaattattttatctttgtcggcaaataaaaagaagtaatgaagttttccgaactaaaactaaatgcaaatgtgcttgatgcgcttgacgccatgcgatttgacgagtgcacgcctatacaggaacaagcaattccaatcatactagaaggtaaagatttgatagcagttgcacaaacgggcactggtaaaacagcagcattcctgctgcctatcctgaataagttatccgaaggaggacatcccgaagatgccattaactgtgtcattatgtcccctacccgggaattggcgcagcaaatcgaccagcaaatggaaggcttctcctattttatgcccgcatcgagtgttgccgtatacggtggaaatgacggaatccttttcgaacaacagaagaagggacttacgttaggtgcagatgtagtaatagctactcccggacggctgatagcccatttaagccttggatacgtagacctttccaaggtttcttattttatactggacgaagcagaccgtatgcttgatatgggattctacgaagatatcatgcaaatcgtgaaatatttgccgaaagaacgacagacaatcatgttctcggcaactatgcctgccaaaatacagcaactggcaaaaacaattctgaataatccggcggaaatcaaacttgccgtttcaagaccggcagataaaatcatccaggcagcttatgtatgttacgagaatcagaagctaggtatcatacgcagcctttttactgacgaagtacccgaacgtgtgattattttcgcttcctccaaaatcaaggttaaagaagtaacaaaggctctgaaaatgatgaaactgaatgtaggagaaatgcattcggatcttgaacaggcacaacgtgaagtggtcatgcacgaatttaaagccggaagaatcaatattctggttgctacggatatcgttgcccgtggtatcgatattgacgacatccgattggttatcaactttgatgtcccccatgacagcgaggattatgtgcaccgtatcggacgtacagcacgtgccaacaatgacggagtagcactcacctttatcagcgagaaagaacagagcaacttcaaatccatcgagaactttcttgaaaaagaaatatataaaattcccgttcccgccgaattaggagaagcaccggaatacaagccccgctcttacaacaataagagaggtgacagttctaaaagaagaagcttcggaggaaaaaggaataacaacaatggaaaaaaaggcaataaccgcccctcttctcctgcaagaaactaaaaaacatttggctatttcgtcggagtaatagtcaacttgccgctaaaactgacagtcaaatttgctatactgtaaatagaactttccggaatggataaaacagcctgataatggaaaccattccggtctacctttacaaatttagtatcagataaaattgcctgcaccaggaaatccgcaggaaccacactttcaaacatctgcttggtaatatcactggcaaacaggctcttcttgccttcatacacacaaatgtgcatcacattatcgtagtacacattatccatactaataccgtcttcagtatatatagtcttgatcaccctcattttggatggattgatatacacataagcacgatagcggctaccattatagttcacaatactatcgcgcttcgttacttccgtataggtgggaataatcatttcctgaccgacaaaagataacgaatcattaggatcttcagatttatgcaatctgatcatattatctgcaatcgaatgaaaccagaaaatatgctccccctgcttatctatcttataataggtagtatcattgccataagtataaagagtatcccgtataattttgaatgtaataggagcgctctgcgaatctgcataatagatggtatccccttctatacgcatcaacgggctctcagtctcatcatccagccagattccttgcagcagttctttcgcactcaaatcctcctcttgtccggaggaagagtgcggattcttactgctgttacatgctgcgagcaagatcgctactaacgatatcgctacatatttcgtcatttgtctaaattttgtgtataaagatactctaattatcttatttaccaatgcatgaataaataaatccgagctcttccatttcttttttatcatagatattgcgtccatccagcacaatttgctgattcatagtctttttgatgacagcccatgaaggcagacggaattctttccattcggtaattaacatcaggacatcagcatcaagtaccgcatcatacatatcgcgggcgtaataaataacatcaccgatacgacgtttacactcattcattgcagccggatcgtatgcgcgtatctgacaacctgctttcagaagtttatcgatcaataccaatcccggagcctcacgcatatcatccgtttccggtttaaaagccaatccccacaaggcgatggtcttacctctcaaatcaccattaaactgcttcatcagtttttcaaacaagactcctttctgcgcctcattcacatcttccaccgcacgaagtacacgcatagtatacccgttttgctcggcagtcttgatcaatgctttcacatctttaggaaaacaagagccaccatatccgatacctgggtataggaacttgcgtccgatacgagtatcagaaccgataccgctacgtaccatatttacgtcggcacctaccagttcacacaagttcgcgatgtcattcataaagctgatacgggttgccaacatagagttagccgcatatttcgtcatttcagccgatgggatatccatgaaaataacacggaagttattcaataaaaacggcttatagagtttcgacatcagtttctccgcacgaacagactccactcctaccactacacggtccggactcataaagtcgctgatagcattgccctctttcagaaattccggattggaagccacatcaaactcaatgttcactcctcttttatccagttcttcctgtatagcggcacgaactctgcgcgcagtacctacaggaaccgtgctcttcgtcactaccaatttatattgattcatattacgaccgatggtgcgggcaacttccagcacataactcaaatcagcactgccatcttcgtccggaggcgtaccgacagcactaaatataacctcaacatcgtccaggcaactctcaagcgaagtcgtgaatttcagtctttttgccttgacattgcgaagtaccatttcttccaatccattctcatagatcggaatcattcctttctgcaaagattctattttctcgctattcgtatctacacaagttacatttacgccaatttcagcaaaacatgttccagttaccaaaccaacataaccggttccgacaatcgctattttcatatctatcgtttgttagagtttattcaaaatatacagcatctctgaaagccatgccctctttatccttgggcgacaaaagcatctgcgactccccaagcatccagtcgatgcctaacgtttcatcattatatactatagacgcttccgcttgcggagcatatttattgtctaccttatacatgaacacagcttcttcgctcaacaccacaaagccatgagcaaaaccacggggaataaaaaactgccttttattttcttcactgagcaatgcgctgacatgttttccaaaagtcggtgacgaccggcgcaaatcgacagcaacatccagcacctttcctttcagaacgcgaactaactttgcctggctgtattcacccttctgatagtgcagtccccgcaatacgccaaaggacgatttcgattcattatcctgcacaaagtctaccggaccgatcttcgcttcaaactcctctttcttaaaggcttccataaagtagccccgttcatcagaataaacattgggttctatcagccacaccccatctatttctgtctgtatatagttcatcgttagtagtaataagtaaaacgatgcaaaagtagtgattttttcgaagttttctgggatatattcaattaatctcttaattttgcactatgattgaattagcacaacacatagaggctctgttgttagagaacgattgcgtaatcgttcctaattttggcggattcgtagcacactacgctcccgcaacctatgtaaaagaagaaaatctttttttacctcctacccgtatcatcggtttcaattctcagcttaaactgaatgacggcgtgttggtacagtcctatatgtctgcgcatgacaccagttttgccgatgctacccgtatggtggagaaagaagtgaacgccttcgtcgagattcttcatgaagaaggtaaagccgatttggaaaacgtgggtgaaatccgttataacatttacgggaactacgaattcactccttatgatcataagataacgactccttcattatatggattggattcttttgagatgcgtgagctctctgcgttgcagcgaaaagaaagaatactggtacctgccagtctgacgaaagaaaagaaaacgtatgaaatcagcatcagccgtacccttcttcgtaatgctgcggcaatgattgccgttatcgttatgttcttcgcattctctactcctgtagaaaatacgtatgtcgagaagaacaattatgcccagttgctgcctgccgagctttttgagcaaatagaaaaacaatcggttgcagtcactcctgtttctgtagaaacaaagcataatcaaaagaatgcgactggtcagacgaagaaagttaccgctgataaagccagaacttcaagacctatcgctgtcaaagaagtcaaggttgccaagcaggaaacaacaccggccgcaccgacagcaacaataccgactacgaccgcagtgacaactccggttgcacccgcagttcagccacaggccaatcatccctttcacattatcgtagcaggaggaatcggtctgaaagatgctgaagcaatggcagaacaattaaaggcaaaaggatttgccgaagcgaaagccttgaacagcgatggcaaagtacgtgtcagcatccgttcattcggaaatcgcgaagaagctaccaaacaactactggagcttagaaaaaacgaaacttataagaatgcctggttactggcaaaataaatccccttttgaaacatgaaacgagttctttgtcctaaatgtgagaattaccttttttttgatgaaaccaaatacagcgaaggtcaatcgcttgtattcgaatgcgaacattgtggcaaacaattcagcatccgtctcggaaaaagcaaagtaaaagcccttagaaaggaagagaacctggaagaagaagcggaggttcataaagaagaattcggttatattacggttattgaaaacgtgtttggtttcaaacaagtacttccgttgcaagaaggtgataatgtgataggccgtcgttgcgtgggtaccgttatcaatactccgatcgaaagcggtgacatgagtatggacagacgccactgcatcattaatgtgaagcgtaacaaacagggaaagcttgtctacacattacgggacgcccccagcctcacaggtacctttctcatgaatgagattctgggagataaagaccgcgtccgcatggaagacggagcaatcgtaactatcggagctaccacattcattcttcatacagctgaagctgaatagaaagaaaactgtttttctcctttctatcagaactatctttgatatcatatatacacataaaaacagcgtcaccattcacaacgaacagtgacgctgtttttatatgatattacttacttaaaggataccctttaccgtttcaagcatacctttctcctgaatagaatccagatcagcctttacagctgctgccagtcccggaatcttattcaaatcttcgccccagataaactctgctgccagtacaccttcggtaaccttcttcgtgcaaccggtagcccaaagctctttcagcaagttcatgatttcaggagcatcgttcggtacaatttcagccccgtctgcacgtacaccacctttataataagtgataatagcagccaatccgagtaccagtcctttcggcagttcccctttacgttccagataagtcttcaatcccggaagatcacgagtttcatatttcgggaatgagttaagcataatgcttgttaccgcatgatcgacgaatggattgttgaaacgttccaatacatcctctgcaaacttcttcagttcctctttcggaagattcaatgtctccatcaattcatcaaacatcactttatgaatatacttgccgattacctcatgttggcaagcatcacgcacgatattcacacccgacaagtatgctaccggagaaagaaccgtgtgaggaccattgagcaaagttactttgcgttcgtgataaggagcttccgacggaacaaacaatacattcagccctgccttatcagccgggaattcttttgccacttcctgcggagcttcaattacccacaggtggaagatttcagcctgcacaacaaggttatcatcgtactgtatcttttccttgatagcagcaatatccttgcgaggaaatcccggaacgatacggtctaccaatgtcgcatatactccgcaagcttcctcaaaccaagtcttgaattcattgccaagattccacaggtcgatatactgataaatcgtttctttcagcttgtggccattcaggaagatcagttcgcaagggaaaatgatcagacctttcgtcttgtcaccgttgaatgttttaaaacgatgatacagcaattgagtcagcttgcccggataagatgaagcgggagcatcttccagtttgcaagtcggatcaaaggcgattccggcttctgtagtgttcgagataacaaagcgcatttccggttgttcagccagcttcataaactcgtcattctgcgtataaggattcaatgcgcgactgattacatcaatcattgtcaagctgttaaccacttctcctttatccaatccttgaaggttgacatggtacaaatcatcttgtgcattcagcatatcgaccatacctttatcaatcggttgaaccactaccacactgctgttgaagtcagtcttctggttcatgttgtaaataatccaatctacaaatgcacgtaaaaagttaccttcgccaaattggataatgcgctccggacgttgtactttaggagctgtttctttgtttaatgctttcatgttagttgtaatttataaagttgatattatacaaattcgaaataaaaatcaatattttcctttatcataatgtcgatgggcatgtactttaccggttcaacggatttcttgaaaacgacgtggtcgcaaagagcttttacgccacaatatccctgcagccccgggcgttgtccgatcagataatgcacatcaccggatttcagcaattccacgtttgctttcagaaggtcatatcctatcagccccttcatgctacgtcccgcactacggagatattcgcccagctgataaactctggaattgaatacgacacccaacgtagctttcggatgcagccggaaaaattcatccaatgtcttttgattattttcctgattagacttgttcagtaccacttcatgaatcaccaactcttcatactcttcggtgataaagctcataaatcctgccaaacgccgttgcatctgtatttctgccggactgttcttattattgctcaagaacaaaaccagctcctgcccctcgccggcctgatagttgcgcattaatattttggcggcaatgtatccgcttttataagagtcctgtccgatataggtcagtgcgttcgcttcctccatattgaagtcaatgaatgcataagctatttttttagcttgcagatagtctgtcaaagccaatgtctcatttctgaagttcggagcgatcagtacagcgtcgacattgctttcttcaactctgcgacacacttccagataactttccttgttcccctgatgatagcaaagataatccacactcacattgaaaggacgcaattcctgacgtgcccgctcgatgcctcccactaccgaatgccagtagtcgtgctctatataataaggtatcagacaaacgaaagaatatttcttcttggcagccagtccgatagcaaatacattaggctggtagtgaatttcatccaataccttttgtactttagccttgctttgaggagatacgtcgccgcgattgtgcagcactctgtcaaccgttccggcggaaacacccgccatacgggcaatgtctttgatggtatagttctggtcctccatagtgctaaaacttaaatattataaataatcgctgcaaatacattactattccgttttatattcctccaaatatacgaaataaaaacaagaaagtcaatagccggacggtatttgccgtgatatttcttcatttatcaggtattaccttgttattcgggcaataccttattataaaagaaaggtttttttcactcactacgtggttatctgaaaataaacacgtaaatttgctggctcaaattgaaataacagtataaatcactataaataaaaactttatcactatggagtacaatttcagggagattgaaaagaagtggcagcaaaggtgggtggaagagaaaacctaccaggttacggaagacgaatcgaagcagaaattctatgtattgaatatgttcccttacccgtcaggggccggactgcatgtagggcatccgctgggatacatcgcttcggatatttacgcccgttacaaacgactgcgtggcttcaatgtactcaatccgatgggatatgacgcatatggtttgccagcggaacaatacgctattcagaccggacagcatcccgcaatcactactaaagctaatatcgaccgctatcgcgagcaactcgacaaaataggcttctctttcgactggagccgcgaaatccgtacgtgcgaacccgaatattatcactggacccaatgggctttccaaaagatgttcaacagctactactgcaacgacgaacagcaggcacgccctatccaggaactgatcgatgcattcgcaatctacggaaacgaaggactcaacgctgcctgcagcgaagaactcagctttaccgccaaagaatggaaagccaaaagcgaaaaggaacagcaggaaatcctgatgaactaccgcatcgcctacctcggcgaaacgatggtgaactggtgccaggcactgggaaccgtattggcaaatgacgaagtcatagacggcgtcagcgaacgcggcggcttccccgtagtccagaagaagatgcgccagtggtgtctgcgtgtatccgcttatgctcagcgtctgctcgacggactggataccatcgactggaccgaatcactgaaagaaactcaaaagaactggatcggacgctccgaaggtgccgaagtacagttcaaggtaaaagacagcgatctcgaatttaccatctttactacccgtgcagataccatgttcggtgtgaccttcatggttctggctccggaaagtgatctggtagcccagctgaccactcccgcccagaaagcagaagtagacgcctaccttgaccgcaccaagaaacgtacggaacgcgaacgcatcgccgaccgcagcgtgaccggtgtattcagcggttcgtatgctatcaatccgtttacaggtgaagcagtgcccatctggatcagcgattacgtattggcaggatacggaacaggagccatcatggccgtacccgcccacgatagccgcgactatgctttcgccaagcatttcggactcgaaatccgcccgttggtagaaggttgtgacgtaagcgaagaaagcttcgatgccaaggaaggtatcgtctgcaactctccgcgtccggatgtaactccgtactgtgatctgtctctgaacggactgaccatcaaggaagccattgaaaagaccaagcaatatgtgaaagaacataatctgggacgtgtgaaagtgaactaccgtcttcgcgacgccattttctcacgccagcgctactggggggaaccgttccctgtatactacaaagacggaatgccgtacatgatcgacgaagactgtctgccgctggaacttccggaagtagacaagttcctccccaccgaaacaggcgaacctccattgggacacgccaaggaatgggcgtgggacacggtaaacaagtgcacggtagaaaacgaaaagatcgacaacgttaccatcttcccgctggaactgaacaccatgccgggattcgccggttcttccgcatactatctgcgctacatggacccgcacaacaacaaagcattggtggacccgaaagtggacgaatactggaaaaacgtagacctttatgtaggaggaacggaacacgctaccggacacttgatctactcccgtttctggaataagttcctgcacgatgtaggtgcatcggtagtagaagaaccgttccagaagttagtaaaccaaggcatgattcaaggccgcagcaactttgtatatcgcatcaaagatactcacaccttcgtttcactgaacctgaaagaccaatacgaagtgactccacttcatgtggatgtaaacatcgtatccaatgatatcctcgacctggaagcattcaaggcatggcgtcccgaatatgcggaagcagagtttatcctcgaagacggaaaatacatctgcggatgggcggttgagaagatgagtaaatcaatgttcaacgtagtcaatccggatatgattgtggacaaatacggtgcagacacccttcgtatgtacgaaatgttcctcggtccggttgagcagtccaagccttgggatacgaacggtattgacggtgtacaccgctttatccgtaagttctggtcattgttttacagccgtaccgacgaatatctggtgaaagacgagcctgcaacgaaggaagagttgaagagcctgcacaaactgatcaagaaagtaacgggagatatcgaacagttctcttacaatacgtctgtcagcgcattcatgatctgtgtcaacgaactttccaacttgaaatgcaacaagaaagagatactggaacagctcgttatcaccctcgctcctttcgctccgcacgtttgcgaagaactgtgggatacactgggacacgaaacttccgtatgtgacgccgcatggcccgcatacaacgaagaatatctgaaagaagatacgatcaactataccatctccttcaacggaaaagcacgcttcaacatggagtttgacgctgatgccgcttcggatgccatccaggctgccgtattagccgacgaacgttcgcagaagtggatcgaaggcaaaacaccgaagaagatcatcgtggtgccgaagaagattgtaaatgtggtagtttaaaataagtaacaggtaataagtaataggtaataaccgcagctgctttccgagcatatccgcaaggttaatacctaatacttaatacttattacctgtacctatcgactacgacttattacctattacttaatacttattacctattaattaaatgcgcaaaccagcaaaagcggaaataatgagagaagtgaaggattatatctacatcactctcggattgatcagttatgctttgggatgggcggcatttctgctgccttaccagataacgacagggggtactaccggtatcggggctatcatttattacgcaacgggatttcctatccagtggtcgtacttcatcatcaatgcggttctgatgacatttgccatcaagatattaggtccgcgattcagcataaagactacttatgcaattttcatgctgactttcctgctatggatattccaggtgttggtaaacaactacatacaaacgcccgatatgtcggccgacggaaaacctctactgctcggcagcggacaggactttatggcttgtatcatcggtgcggctatgtgcggtgtaggtctgggcattactttcaattataacggcagcaccggaggaacggatatcatcgccgctattgttaacaaatacaaagacgtatcccttggaaggatgatcatgatttgtgatgtgttcatcatcggttcctgttactttgtgtttcacgactggcgtcgggtaatcttcggtttcgtcactctgttcatcattggtgtcgtgctcgactggattatcaacagcgcccgtcagtccgtacagttcttcatcttctccaagaagtatgatgagatagccgaccgcatcattaaagatacagaccgtggggtgaccgtgctcaacggtaccggatggtacagcaaaaacgatgtaaaagtattggtcgtactggccaaaaggcgtcagtcgctggatatcttccgactggtaaaacgtatcgatccgaacgctttcatctcgcaaagttccgtcatcggggtgtatggcgaagggttcgatcagttgaaagtgaaataaacaggtgaatgaatccggataattccgctaaaaaacaagaataagacaatgaaacgcaaacttgtatttgccaccaacaatgctcataaactcgaagaaatagctgccatcctcggggataaggtagaactgctcagtctgaatgacattgactgccacacggacattcccgaaacagccgaaacgctggaaggaaatgccttgctgaaatcttcttttatctaccggaactatcagctggactgctttgccgatgacaccggactggaagtggaagctctgaacggagcgcccggagtgtactccgcccgctatgccgaaggcgaaggacacgacgctcaggcgaatatgcgcaagctgctccacgaactggaaggaaaagagaatcggaaagcgcaattccgcactgccatttcgctgattctcgacggaaaggaatatctctttgaaggtgtgatcaaaggggaaatcatcaaagagaagcgcggagattccggcttcggttatgacccgatattcaagcccgaagggtacgaacagacttttgccgaactgggaaacgaaacaaagaacaagatcagtcaccgtgcactggctgtacagaaactttgcgagtttctgcaacgctgattctttagcatattccgcacaacagcctgtcttgacatcaacgaagtgccagcagtaaaattctctcaggtcatttcttaactatatgacacagagtttaataaaagaatttttgtaatcttcagaagaaaattatttctttgcaaaaaaaataaagcgtaatgaagaaaattgcattatttactttccttacattgttattatgtacttcatgtgtaacgaaaaagaagttcatgatgacagaagccgcacgtattgcaagtatcgacagcttgcaaagtttattgactgattgccgcaacacgggcgaccagctgtcagcacaaatcaagaagctcctgcgtgataccacccagatgggaaacagtatccgtcagtatcagagcatgcttagtactaacatgacggaacaggaaaaactgaatgccttgttgagtcagaagaaaaacgaacttagcgaaagagaacgcaccatcaacgagttgcaggacatgatcaacgctcagaacgagaaagtgaaacaactgctgaacagtgtgaaagacgcgttactgggctttagcacagacgaactgacggttcgtgaaaaggatggaaaggtgtatgtggcaatgtcggacaaattgctgttccagtcaggaagcgcccgtctggataaacgcggagaggaagctctcggcaaattggcggaagtcttgaacaagcagaccgacatcgacgtatttatcgaaggtcacaccgacaataaaccgatcaacaccgtacagttcaaagacaactgggatttgagcgtgattcgtgctacctccgtcgtacgtatcctgattaagaactacggtgtaaatcctttgcagatacagcccagcggtcgcggcgaatatatgcctgttgacgacaatgaaacagcggaaggcagaagcaagaaccgccgtacggagattatcatggctccaaagctggacaagttgttccagatgttacagacttccgaagaggttaaataagaaaataataataagagactgtcaggaggtagacagtctcttattatatagaaacaaggctataatatttattgccctatatgatataactcatccatgtttctattagatacaatatctgaattcatactgtttactttccccatccggatggtttcttacccatcttgaataccatcgtaccaccgttcatgatgtcctgatgagtgatgaagaaatctttgtgtttcttcccgttcaaagtcaccgactgaatgtagatatcttcgggagacttgcggatggtccggatacggaactccttattacctgccagtttcaaagtacactcatccaaaagcggggaaccgatgatataccggccgtcggcaggattgaccggatagaatcccatcgcactgaatacataccaggcagacatctgaccgcagtcatcatttccggcatatcccgaagaagtgttgttatacagcgtgttcagaatatgactgacatacttttgcgtcttccacggctgacctgcaaaattatagagataagctacgtgatggctgggttcattaccatgtgcatactgtcccacaaatcccgaagcgttatgattcatctgctcactcttataggtagaggtaaaaaaggtatccagcttttgttcaaaggctttcgttcctcctgtcagttccatcaaggcctggatgttatgcggaacataccaaaagtattgccatgcatttccttcggtaaacggatgcccgccgtttccaccgtattgatacgggtcgaaaggttcgatccattctcccttgtcattcttggactggaagaacttcgttttcggatggaaaaggttccggtaatattcggagcgtttgtggaatcgctgataatcggcatccttgttcaattttgcagccagttgggcaacacaccagtcatcaaaagcctgctccagagtgatggagacagattgagtctgaatgttttcgggcataaagccgtatttctcccatacctcaaaaggagagttggggtgtgaggttaccgaactgttatagactgcttcataggccttctccatatcaattccgggaatacctttcaggatggcatcagtgatcacagggatggagtggttaccgatcatacagtaattgtcctgtccccataattgccagataggcaggtagccgtaatattcatactggcgtatcatgctcttcacgaagtcagtcacccgttcgggttccagcaatgtgtagagaggatgagaagcgcggaaagtatcccacagggagaatgtggtgtaatgagtttcattgttcgctactttgcgggtcgtatagtcggcagccatgtattcgccgttcacgtcggacatggtgttaggctgtatcatggtgtggtaaagagccgtatagaatatctctttctgcacttccgtacctttcacttcgatctttcccagttgtttttcccaatcagcgtccgcagcagccacatagcggtcgaaatcccagtgcggtgcttcctgttccatgttctgacgggcattctccatagagacggatgaaagggctaccttacacgtcagtggtttgccattcagttggccgaaacggaaacagccatgaagattcgtaccgttgatcacggctgtgttttcatgaacacgcccgccgtctctcagcgtagaagtaaggataggactggaaaactccatgtagaaataaatcttgcgcagtttcgcccatccggtgatgatacggtaaccttccactgcatgatcattcagaatgcggatctgagagttaatgatccggcgtccccaactgcccttatctgccgagtggtccatatccaatataatctccgcatctttgccggcgggatattgatagcggtggataccgtttctctgagtagtggtaagctctgcattaatattctcatctttcagcattacctgataatagccgggacgggccttctcttcgtcatgcgtgaatgcggaagaagtgcgtccgctactggtcggcatcaatgtaatgtcgatcaggtccgaggctcctgtcccactcaggcgggtatggctgaaaccgaagatcgtattccggttatagtcgtagccggaagcgtccccccaattgggagcttcgctggtgtccggagaaagctgtatcataccgaacggcgaggtcgcccccgggtaattattacccgaaagtcccccatcgatggcccccgttccaataaacggatttacatatttagtgatttcccctgcctgcaacgtagcgagagtcaatgaaaatgcacatacacttaaaagtaatttcttcatggttcatggtgtttttataagatatgtttcttatgtctatggctttttattcttctgttatttcaatgagacggctgttgagctgctgtgttgtgaaaagatccagtccgacgttcattagatattctccggagaaaacctggttgttacccttcaatgaggaaccgctaccgggcatcatattgatttccttcacacggtacttcttgtcggcattcaacccttgcaggcggacaggcaatgtcttttccgcatagcgcggatggatatcgaaggcaaataccgcagccgttttcttgtccttgcctacaaacatggaagaagtatggttgcttccgtaaggagaaacgaggcgatacaaatcaccttcaaggatgacaggtttcagacggttgtagttcttgactgcctgatcacagtaaaggtgctcattctgattcatgtcttccagtttgatgtcgaatcctaatttgcacatcatggctacatcggtacggaacttgatactggttccacgattccaagtagtgacgtgggcacacagtgtcttacttgggaagatctgcgaatagccccattggataaacaggcgttcgataggatcggtattgtcgcttggccagaactctgtgaagtacttcaatgcttcatagtcggagcgtccgccgccaccggcacacagcatcatcggaagattaggatatttagccttgattctgtccagcaccttgtaaagtccgcgcacataatcaacgtacagatgagactgtttatctttcagatacaccgaatagatattcgtaatcgggctgttgcagtcccatttgaagaaagcgatgccgggatatttggtcatcaggttgtccaccacgccgaatacatgatcctgtactttcggattgctaaggtcgagcaccatctggttgcggaagtagtattcatcacggttaggcagatgaatcacccagtccttatgcttttcgtaaagctcgcttttgggatttaccatttccggctctatccatataccgaacttgatacctttcttttgtgcttcttcaacaagacgccctactccgttcggaagtttgtcggcagtctcttcccagtcgcccaacccctgatggtcactgctacggggatatttgttggcaaaccaaccatcgtccagcaggaacatatctacgcccagcttggtagcctcatccatcaagccgatcagtttattttcatcaaagtcaaaataggtagattcccagttgttgagcaaagtcatgcgggtatcattaccgtttttcacctgatgattgcgcgcccagtcatggaagttacggctggcctcacctttcccctgcgtgctgtaagtgaaatagaagtccggagtacggaacacttctctggcgggcaggctgtattcggagtcgtacgggttgataccgctgataatacgcagttcgtttttgttgtccacttcgaaagtaaagcgaaagttacccgtccatccgatggttcctaccagcacttcgcctgcattctcctgcgaaggattgtcaagagccagctggaagaaaggagatacaaacatattggcacgtgcacccaacttcgtatcgatcacctttttaccgaaagccagttctctttcggtcacgttggcttcgtgtgcccagtcaccggaaaattcagtcaggaaatacttgctgctgttcaggtgaagcattgatgaagcatacttgcaaagtatcacaggtttcttctcttcatggctgatttcagtaaacgtacggataatgttctctttgccgtaagccacataatgcagcttcacggtcacagggtatttatcatccttaagggtaattacggtttcgttgaccccgttaccgatggcattgctcgaatgatctacgtatttcagcagcaatgaagagttattatcgttatgacgtatgtgaatagccggttcaaagtagtcctccataccgtgagtcagataagcttcagtcccttgtggcagatactggatatcggaatcatggttaagctttttgcccaagtatttctgatacagacgtccgttgtcagctacttgatagataaggctggtccgttcggtttctattttgatcagcggcttgtcggcagcctgcaaaagagaaaaagaactcaatagaaaaaaaagtaagaatgcttttaatttcatggtttacattgttatggttgatatttattctctggtgcggaacgggggtacgggaagcccgttcttgccatatagattacaaacaggattgtctgcccacgcatagcaggccgccgtcggtatttctatccggtcggattgcagaatgacttcttttccccggataatagcctgtgccggaacgtatttcccgtccggtcctgccagtataaagcctttcggagtaccttctttggctactacttcctgatcgaaactaagaatcagcgtacgtcccgaaatgcggtatccaaggaatgcgggcacttcgtatgtacctttgttataggtcttcgccaatgccgcttgcgccagtcgctttcctacttcctgtttgtttttcgggtggatatcataagcttcgccgaggtcgatggcacatgccatacctgtattaggtaggtgcagcgcatgtgcctgtgcatcacggagagccgcccatttggagtccggctgtacttcttccggcttcagataattggccaactgcacaaagtagaaaggaaaatcctgtttccatgcccttctccaatctgtaatcattgattggaaaagtactctgtactgctcgtcgaatcctacattattttctccctgataccagatagcgcccttgatagggaagacggtaaaaggatgtatcattgcattgtaaagtacggtcggatagcaggatgtcggccagccggttccttcgggagacaatggtctagaaggtgcaccggtcatcgatactccggtgtgatagttccagttgcccgccaaggaaatcttcttgtcgttcgcttccatatacatctgctgaggttctccgtggataccgccttcgccgccataatctatggcacggatggtgataacccctttgcctgcctttgccaaggctgcgggaatcttataagtacgcatcgtattgcatcccgaagttcttcctatctccttcccgttaaagtaagtaacatcgtcgtcgtcgatcatagccagatggaaggagatttccttgccgttccagtcagcaggtatttccacttctttctggaaccagacagtgccgtcaaaattcagtccgcgagtttcccaataagcgggcagttccatcggtttccattcattccctgtctgaagagctgatatccattggggaactccgtctttgaatccggcatccttggcatcaaactgctgaagccactcgtccatttcccgatggtaaagttcgacaagtttctctctttggaagcctgcgctttccatttcggccatctttttctgaaatcccacgacttgcttcaatgtctgatggcttgtccatgattcggcaggtgtgccgccccaagtgcagtcaatcaccccaacgggcacattcagttctttccacaacttacgggcatagaaataagcaacggaagaaaactccggtacagtagcggaactacattcctgccagccgttcatattcatttctacgttatcctgcggagagaaagcgacggtcttctttacctgcaacagacggatggaaggataatcggcatcggcaacctcctgttcgtaattcatcacttttccccatccggcaacgggcatttccatattcgactgaccggaacatatccagacttcgcccgataagacgttgttcaacactagtttctcaccatccgaaacaatgatctgataaggtcctccggcaggcggagtcgggacttctatgctaaaatgaccatcagctgacgctttagccgtatatttctcatgattccagctcaccttcacagtcacttgtttaccggcttttgcttttcccggcaacgtcagctgactgttttgctgaataaccatattatcggtaaagaatgacggcaatgtgaccttcgcttgcgcaaaggctgccacacataacgataagagtgttaattgatattttttcatttcttcggttatttaaattcaagtaattgcacgtctttggagggtacggtcacttcaagctgtcctgtggcaaaagtctcattgccgctccacaactctttcacctgatagccgcgtgccttgtccaatcctattctttctaacgaaagcacagttgtctgttcctggtccgagtagttgaataccgcacaatggaaacgaccatcgggtgtcttccttacaaagatatgttccgacttctctccgtttccttccacgggacggaacacttctcctgtcgctactgcattcactgccgcattggtcagatatttctgtgacttttctttggcgtcttttcctcctcccgcactgaaatcgtctcctgtaatgtaaatacccgtaatgacacccgaagtaatacgggcacggttttctccgtcggtagcatctctcagtacaatatgatcggcatcgttatattgatagatatacttctgccaccagccgtatgaaagagcgttcaatgtatattcggtatccttgatctgattccacgcatcacaggctattctgcgtgactgcgcatactgggcagggaagacaggagaaatggagagattgatatacatatctccaaaatattgattgagcagtttcatgccataattatatccctgtatacctgtggtaatctcaggattataccatttgtccgcttccatcgcaccgtgtgtcatgaagtccatcttcacatactcgaatcctgcacggtggaacaaaccggaagtcttcttcatcatagcttccactgccggatgcgttggatcgactgcataagcgccgtccagttcctgcggctttccgttggcatagagatagatatctttgtatttatattccggtgcggcatctaccgtccgttccggatcgcgtgcccagtcggtgaacggagtccagtagataccaccgatctgtccgttcgacttacatttttcgataaatgacttcagttgctcctcattcatacagtcccaaccggaatccagaccgatatagacagtctgatcagggtttacaaaatgattattctgcagattctccttgaaataatcggagacttccatcgctttctcataagtcagattgaattgtaatgccccccagctgttccaaccaaatggaacagctttctcccatgctttgggaggggcaattacagcgttggcttttgcatacgcttcaagtccatcgcaccaatcttcaaagaaacccaaaaagactttaggggatttaatctttttacctgctaatgcaccgtgagcctttacgtcacgagtctgctcatctgctatgcccccataacataccagcgaaccaatgttatcacgatcccccttacctattgaaatacctgttttccagttatcatgttctacggagccgatcaccagaccgttccggctttcattattgaatatggctgtcacttcataactcaccaatgtatcgaaaccaagcgggtgagactgatatctgatccatttgtcattgtcgaacggaacaaaaagagcacggttatcacctgcctgcaagaatccggatatagaatcgacattaacaggagccattctgccggaacggatttcctctttcgcttcgaccgtaaaatcggtcagtatatattccttacccggataaagatagaaatactgagtcagcttcggaagctccttatccgtatactccaccttatatatatgtcctttcccgaaagaatcggaaactttgcccgtactgattttatggcgggcatagtcacttgtcttgatctccttcccttcccattgataggaagcatacattccgttacaaatattttttgacttataagtgagtgctattcccccttgctgatcatcgtaagttatattccatacatcggtagagaaaatcttgtctccactggcacagttggaaatgaaaagaaacagaagaagcatcagggatactcccgacattttttttagtagtagcttttggtttttcatatggtacaatgttcttatgtaaaaaaataaagcatacccgaataagaaacctttttctcttattgaggtatgccacaaaggtaaggattggcatctcctttactatatacaaacgattcaaaaaatgataaaaatacggcaaataagctccaatgcgggctaaaagaggtattttatctattttgtgccctctcctgcctcgacattctttatctcctgcgtgataatgatctgcttgccggattgatattgtttctcaaaatctttgggtgtcatgccgaattgtttcaggaataacttgctgaaataagacggcgaattgatgccgaccatatagcagatatctccgatccggtatttaccttcctggataaactcggctgcctttttcaacttgatcaaccggataaaatcgagcggagacaagttgaacagtgtcttgattttccttaacaaactagaacgactcatgcagagtatatccgccatccgttctacaccgaaattatcatcggttatgttatcttcaatgaccttgatcactttattcataaattcctcgtccgccttgttcatctgcatattgttgacagagaagaaggggcgtttcgcaaaggcttctctttccctgcgcctgttgtcaagcaaggacaggacttgttctttcagataattgaaagagaaaggtttctcaacgtatgcttccgcaccatatttcagaccgttgattttgctgtcgatgtcattcttggctgtcaggaagataataggaatatgagaaagctccatatccgattttacttccttgcagagttggtatccgtccattacaggcatcatgatatcactgatgatcaagtcgatatggctgcttctcaatatttccagtgcttctaccccgttcatcgctgtctctacggtgaagttttcctgcaagcgttcgagaataaaggtcagcatactttcgttgtcttctaccaacagaagggtatatccatacatatcggccgtgacgggcgtatgttcgtccagctcgacaatgtctttctgtatggctttgttgttctcctgtttaatgccctccatattcaaaggaatggtcagtacaaacatattgttttcctgacgggtatccagatagatcgtgcctttgtgcagggatgccaacgaacgtgccagagacaagccgatgcctactccattacggggcttctcctttctgtccacctgatagaacggttcgaatatatattggctgacttcggccggaatcttgtttccatcactggtgacacgaatcgtaaagctgtcttctcccttttccagttctaccagtacattctggctagcatacttcagcgcattattgagcaggttgctcagtatcttggtgattgcttctttatctacagctgcccacacctgctcatctgtcgattttaactgcaattctttccggttcaggctgaacgtcacttcaaagcgtgccacgattccggcaagaagttcggtaatgtccacgctctcaaatttcatggtcagcttgttggcaccgatcttctggaagtccagcagttgtccggtaagttccagcaggcgtttggtgttctggaccatcacactgatatacttcttcatcttgggctcctgtatctccatttcctcaatggcttcgagaggaccgttgatcagtgtcaaaggggtacgcacttcgtgcgctatctctgtgaagaagtccactttggattcgtacagttccttctccttttcgatctcgaacagcttttgccgttcttccagttgtttctccttgcggcgtttgtaccataagatggtgccaaccacgatcaggataatacatacggtatatacaatgtaagcaatgatagactgccaccacggaggaagaatgataatagacagagagcgtgtggacgactcggacttgctgccgtgagtagcctgcacacggaaggtgtattttcccggcggaagtttggcatacgagatgttctggttgctggctgcccgtacccaatccctgtcaagcggttccatacgataatagtattggttggactcggccgtagagtagctgagcaatgccacatcaaagcttatattggcctggtcgtaaggcaggacgatttcatccgtatgtacaatacattgtttcaggggtgattcaggagtatgcaccgtcacctccttattatatatactgaacttggaaatgtaaacaggcggaagcggcttttcctcctcctgaacagtaggatcgaacgcgatcaatccgtccacccctccgaagtagaaccttccatcctgagctttcaatgccgattgataattgaactgattacccagcaatccgtccttattggtaaagacacgtacatctccactctcgggattgaacttgaccaatcctttattggtgccaaaccacagatttccggcatcatcttccaatatgttgtaagctacgtcatccggtagtccgtcttcaatactgaaagtggtaaagttgtcctgcgcttcattatatctgcatataccaccacggtcggtagagaaccatatattccctttactgtcctgcatgatggagctgacggagttggagcttagagagttgtcaactccttccttataagaataattcttataagaattattcttaggatcacatttccaaacaccatttcccatagtagcaagccaaattgtaccatctctagcctccattatatcgaaaacccagttatatcctacttcttccacacggtgaaatttcctttccttaggttgtgatacatataatccccacccaggtcctatccaagtacgacctttactatcttttaaaaaactatatacacttccttcttcaatacccaaatccttatcactgacgtatttaagatgttcaccaggtatactaatatcattcattccttgtttaaataatccaacatatatatgattttcataatgttttactgatagtgtaatgagacgacctggaacattatcatatatctgatgtactttacctgttcgaggatccaatacattaacaccattatcttcagtacctatccaaatacacccattattatcttctgccaatccacggatacgtttggtatttaaagaatatgaatcgcttcccggtacatatttagcaaaagtcaagatacgattaggcagatagttgacacctccaaacattgttccaatccaaattcctccttcataatctttataaatagaataaatactattatccgatatgtaatagattagaaagaatattgtaccagcatattcagccgattggcatggcgggtagaagagttgaaatcagtgcgccatcctctcagatattcaacacctacttgcatattgctagtcacattccagaaagcatttgctacgaaatactgtccttttcggtatgcttccggattatcactcggatagttgttttcagagtaaagtctggataagctgtatgtaccggatacaaagatattcgggcaaatattatattgcaaccccgcataccagcccagcatcggaagaacctgcatcttgccttcattatccggatcgggaacgatgtccacattcagattacttaagtcgttcagataagaaccaattccttttccataattaaactgtccgaacacttgccacttcttggttacattaaaggtggtagatgcttgcaggccaaatccggtagtcgaaaaagccttgtcgtgcacattacttgaataagtcatgctgcgtacgattgcacccaacttaatatgactgttactattccagttatactgtgcagaagctgcaaaatccggcattcgttgcgtgttgatagatacatcgctattcgttgtaccgtctaccgaaggcatttccatggcaacgccgaatctccagtttttcagtttatcgcacatataactcagttgagtggtacgatagaaagcggaaccgttcggaccggcgaagtcaattgttgcaggcagagccgaaaggtccatgaatgaaccgtagctgtatccgatggtaaatcctaagaactgcgcatacgcattttgaagttcaaacgtcttcccatctccacggaagtttccggcggtatacaccacgaagtcgcccagatgcttggttcgtcctaccaatttcaggaatagggtagaagtggtgatgtccatctgaaattgattcttggcaaaatttccctttccgggctgtccgatcaatgccggatagaaatccacatcgtcaacgatgccgttgaaatcatactctgccgtcgcacgtacgtagccaccgataccaagggcgaattttcctttctgatccgtcagaaggaagcggggagcattcgggtcgtgaaaacgcatctgagagcggtcgttcatgattcggatgatttcatctccggccttgtccctggagacgaacatgatggaattcggttcctcatcctcgatgactactttcttttgcgcatgagcacagacggggaaaattccgatccccagtagcatagctaccattttaaagcttgttttcattatcagttaagttttaggtgaatgcccaatgaacaactaaaaaaagaaatggttgagaggggctaaggaaaaattgccaaacttatcggaagaattgctatttataatcgttctaaaaaagcggatctttgtatcgtactaattagataaataaaatacgagaatggaaaaagtagattttactcaaggaatattggcgatggagtcagacctgcatcgtttcgcatataagttgacttcagaccgtgattctgccaacgacttagttcaggattgtgtattgcaggcattggataatcatgagaaatttacgcatgccaagaatctgaaaggatggatgtttaccatcatgcgtaatatctttgtcaacaactaccggcgcacggtccgcgaaatgaatttgatcgatgatacctattccatcaatcagcaaagtttgatagaagatgaagaaggcgaccgtttcgagtttgcttatgacatgaagcagctgtatagagtgatccattccatccccgaagatatgaaagttcctttccagatgtttgtagctggatttaaatacagggaaattgccgaaaaattaggattgccgatggggacggtaaagagccgacttttctttatccgtaagcgtctgaaagaagaattgaaagacttctcctgatgcaactttctaattgagtgatgtgttttaaggtcaaagtgaagccttcctgtcaaaatacgacgaatgacaggaaggcttatttaatttgaaatattcttccgaaatacttggtttataaaataaacctatttatatttgcatcgagtaagagagatgcgcagctccttactttttttaatccatataaggtttataaaataaactaattaaatcgtatcaactaattgattggaggaaagtaaaagatgaaacgcttgttattcattgctttagggattatttgttaccacgttgttacttttgcacaagaagtaaaagtagaagtgcggggtattcgtagtgcaaaaggcgctattatggtcatggcacaacaggattcggaatcgaagccggtatatgcgatggctactgctgttaaagatacagtgactgttgttctaaaagatgttccatgggaaaagtttttaatctctcttttccatgatgagaacggaaactgggaattggacatgaatgaacagggaataccggtagaagggtatgcccgggaaaaatgcaagaaagaggcggatgcttcggctaccgttaaaatgaagatgtattatccggtaaatgactaacagtatgcgatacctgatatttctgatattggccggctttaccggagttactgcttgggggcagacttcgacgactgctcggccgatggctgtgaatgatactctgacagaagattccacttatgcgttgcaggaagtggtggtacggacaagtcctgtgaaacggaaggcagaccgttttatcctgtccgtccctcctgcacagaacaaagacggagtcgaactccttcaacaagcgcccggagtatggttgtccgacgagcggatttccatcaatggttcttccggcacgaaggtgtttgtagataatagggagataaaacttaccggagagatgctgataggctatctccgttctttgaaatcggacgatattgcccgcgttgaagtgcttccaatggcgggagccgataaggatgccgatgctcagggaggtgctatacatattataatgagacgtcatacggacaaaggatttcagggaaatctttctatgaatgcttcttttgcctcttccttgcaatcttatcagcctagtggtagcttgaattatcatagtgggaagtgggatacctatggatttgcttccggtactttggttcctcagaataaaggagatttgtacgttacccgtgattatgtagcgggagataaaggtttttccagtctggcccgtatgaagcagccttcgcgttacgggacgattcggatgggaacagtttatacgatggactcttccaatagtctgggagtagagctggagtatgttcgtcgcggatacatctggccgtctcagagttactctactctgtcggtaggaccgctggatatggaaagtcagggtgtgtatcgtcagaaagagacttacaatatgtatacagctactgccaactatatacataaactggataaggacggttcggtgctgaagcttgtcaccgactatatctctaaagatctgcatggcagaaatcagtatcaaatttttcaggagataggtgctctaaataaagataccgtttaccgttcccgctctaatgccacttatcagatcgcaactgccgatctgtcgtggaaacaacagttacataagaaatcgtttttccagataggaatgaaatatacctatacgggaatgaaagatgatgcctgttacgaagggctggaacctgacgaaagttggaagcccaatgttgcttatggatatgaactcgattatcacgagaatatcggtgctttatacggaacttattctctggatatgaaaagaggatctgttcatattggacttcggggagaatatacgcaaacctccaatgaaacagaacgtcggacgagaaaatactgggattggtttccacatatcgacggaaatttctattttgatgaaattcacaagtggatgcttatcggtcagtatggacgctatatagaacgtccgactttttcggctctcaacccgaaccggattcagacttccgaatatagttatctgataggcaacccgatgttgcgtcctacttatattaataaattcagtattacgctggtctataacttccggtatacattgactgttggcggcaatttgcaccatgatctgatccgtcagtttggtaaagaagatgcggagaattcggatatatcatatgtcatcaatgagaatcacaatcgtgagaaccattggttcgtagccatcactgctccctggcagccgctcaattggctgaatctgaatgccagctttatcggagtgaggcaagatatccgcatgtatcgggaggacgattactttgggcacttcctttatttcgccaatgctaatgctacggtccttttaccgtcagactattcgttggaagcacaatataatggagttagccggttgtattccggtaatagcgggatcgatcctcgtcatacattcaacctgcacctgcgcaaaaaatggaaagacgggcgttgtgtagctactttgggggtagacaatatcttcaaccgatataattcttatttcagcaatgtaccgagttattcatctcaaaatcgttttgaactggcttcgagcggaagactgatgaaactcacatttacctggaatttcaatcatggaaagaaatcgggtgcggtgactgtagaaaagaaatcggcaagtgaaagaagccgtatcgaaggaaaatagacaaggatttttggtttattacgtaaacaatattatttttgaaacaaaattgatagaatatggaagacaagagaatttcagagaaagagagtttggaactgattgcctgcatgattcgggagacgcaggacaatacagcccgttatgcagcctacccattattgatatggggatatactactgtggctatatcacttgtggtatggtacttttatttgcagacgggagtgtggcagatcaattttctctggtttgctttgcctgtcattgccggaccgctgactatcttttttaataggaaagacaagaataagggagcaaaaaattacatagaccgggtgactggtcagatatgggctgtgtttggagtagtaggtttttgtctgtcttgcatggcatttgttgtccgtattgatattctgtttgtaatttccttattgatggggatgggggctactcttacggggttggtatgtaagtacaagccgcttagtatagcagggatgactggtatcgccctttctttttccatgctttttattcatggaagcggggtatatctggtgtttgccgccatctttatagtgatgatgattgtccccggacatattatgaataaacagatgaagaagcaatgtttaaagaactgaatcctatcttgcattcacagcttcgcttggctataatgtcgattctgctgacggtggaggaggctgagttcgtctacttgaaagagaagacccagtcgacagcgggaaacctcagtgtgcagttggataagctgagtgaagccggatatatcgaggtggaaaaaagctttgtaggcaaaaggccgcgtactgcctgccggatcactgccggaggcaggaaagcgatggaggaatatgtggagacgctgaaggagtatctttcggggttgtagttcatgccccgaataaagttatcggataactttgccttctcgcttttttcttctacctttgcaccccgaaacaagtaaaaagatgtatgatgccgtgaatagcggtcgtgtattctagaacaccacgtaaaaaacaggagttatgaaagaaaaagtatcagtaccttttatgttgctgggcattctcttcaatgtatgcctcattgcagccaatcttcttgaaacgaaagtaattcaggtcggcagcctgactgtcacagccggattattggtttttcctatttcttatatcattaatgattgtatcgccgaagtttggggattcaagaaagcacgtcttattatctggagtggttttgctatgaacttctttgtggtagggcttggcttgatagctgttgcgatacctgctgctccgttctgggaaggcgaagagcatttcgattttgtattcggtatggctccccgcatcgtagcagccagtttgatggctttccttgtcggttcattcctgaatgcgtatgtgatgagtaagatgaagattgccagtcaggggcggaacttctctgcccgggctattctctcaacgattgtcggcgagactgccgattcgttgattttcttcccgatagctttcggaggcatcattgcctggaaagagctgcttatcatgatgggacttcagatcgtactgaaatctatgtacgaagttatcatccttccggtgactatccgcgtagtgaaagtgattaagaaggtagacggcagtgacgtgtacgatactaatatttcttataacgtactgaaagtcaaagatatttaatgaaacgacttcttccggcctgcttcgagggctgagaatataaagagaattttatgatgaacagagagactgcattggttgtgttcagtggcggacaggattctaccacttgcctcttttgggcgaaacgcaactttaaaaaagtatacgctttgagtttcctttatggtcagaagcaccagaaagaagtggaactcgccagagaaatagcccgaaaggcagaagtggaatttgatgtgatggatgtgtctttcataggaacattgggacataattcgttgactgacaccacgatggtaatggatcaggaaaagcccgcaggcagcgtccccaatacttttgttccgggacgtaatctgtttttcctgagtattgctgcggtatatgcccgcgaacgtggcatcaaccatttggtgacgggagtttctcagactgactttagcggctatcccgattgccgggacgcgtttattaagtctttgaatgtgacattaaacctggcaatggatgaacaattcgtgattcatacccctctgatgtggattgataaagcagaaacttgggctttggcagatgaattgggagtactggatttgatccgtaacgagactttgacatgctataatggcattcagggggatggttgcgggcattgtcccgcctgtacgctgcgtcgtgaggggctggagaagtatttaaaaaagaagaatcaataatatctctacatagagactaaaaacgtgttttttattgtcacttgtcacttttgaagattaactccttgattacgaatgaataaagggtgataatagatggtgataatagggtgataataaccgataaatgcttttttattgtcacctttattgttgctgacagctgcttgccattctattattggtgttcgtttcatttcgggatgtgcaagggtaaagaagtcattgccggttgtttcaagaagtttcaagcggttgaaactttggttccataggtttgaaaccttagttccataggcttgaaactttagtttctattacttgaaaccatagtttcatacgctcgaaacttttagtttcaaggctttgaaactagagttccatcatagtgaaacacttcattcctttataggaaacgactaaaagcaacggtcgttttgataataggagtaccggatgataataggaataccggatggtgaaagatgaaagatcggtgaaagattgcaataatcaatctttcaccgctgaaccatcgatggataagccgtttcagagaatatggtgacaggtgaaagatgttttgcgtttttttctatatgaagagagtttaaaactatattaaacaatggctgaattaaaagaccaactttccttattaggaagaaaaacggagtataaacaagactatgctcctgaagtattggaggctttcgataataagcatccggaaaatgactactgggtacgtttcaactgtcccgaatttacaagcctgtgccccataaccggacaacctgactttgcagaaatacgtatcagctacatccccgacattaagatggtggaaagcaagagtttgaaactttatctgttcagcttccgtaatcatggtgcatttcatgaagactgtgtgaacatcatcatgaaagatttgataaaactgatgaatcccaaatatatcgaggttacgggtatctttactccacgtggcggtatttcgatttatccgtatgccaattatggccgtccgggaacgaagttcgaacagatggcagagcaccggttgatgaatcgggaataaccagatataaaaataataatacgagcagaatatgactcataatatacctactgaattgcagagatacgtgcaggaaaggattatcccgcaatatgccggctttgataaggcgcaccagatagaccatgcagaaaaagtgatcgaagaaagtctgaagctggctcttcattatgaagtcgattctgcaatggtttatacggttgccgcttatcacgacttgggtttatgcgagggacgtgaatttcatcatatcgtttcgggcaaaatattgttggcggatgaaactttgcgtcagtggtttaccgatgaacaaatgctgcagatgaaggaagcgatagaggatcatcgtgcctccaaccgagatgctccgcgaagtatctacgggaaaatagtggctgaggcagaccggattattgatccggaagtaacactgcgccgcaccgtacagtatggtttgtctcattatccggagatggataaagagcagcagtatgaacgcttccggaaacatcttgccgataaatatgcagaaggagggtatctgaagttatggataccccagtctgataatgccggacggttggcggagttgcgtcagttgatggagaatgaggaagaactgcgaacggtatttgataaattatatttagcggaaaactcagcaggataaggagagtttgctgttgaatggaggcatgttattcatgatgatacggccctccattcaatatcgtcatcgcccgataaatctgttccacgaagatcagccgtatcatctgatgtgaaaacgtcatcttcgacattgaaatcttttcattagctacctgatacaccttctccgaaaatccgtaaggaccaccgatgacaaataccaaccgcttattcaccgtattcatcttccgcttcatgtaatcggcaaattcgagtgaacgcatttccttcccgtgctcatcgagcagtacgatcacatcccccggttgcaacgctttcaatatcagttccccttctttctccttctgctgatccatcgaaaggctcttggtattcttcagttcggggatcacttccatatcaaaagtgatgaagcgtttggtacgctgaatatagtcattaatagctgtaatatagtgttgttctacggttcgtccaacgacgagcaaagttgttttcatgcgtctgatattctgattcgagcacaaaaataggcattttttatgttattctgcaattaatgcttacctttgcctatcattagttgaaagtttaagcctttaaacttcaacccaaaagcttggatttatgaagaaacgagtgcttttaggaatggcctctttgcttctttctgtctcattgctgatggcgcaggagataccggcaggagtgattacggcatttaagcggggaagctcgcaggaactgagtaagtatatgggagacaaggtaaacctcgttctccaaggcagctcggcaaacgttgacaagaagaaagcgacagcaatgatgcaagagtttttcacggaaaacaaggtcaacgcatttgacgtgaatcatcagggaaaacgggatgaatccagttttgtcataggtacgctgacgactacaaaagggaaattccgtgtgaactgcttcctgaaaaaagtgcagactcaatatttaatacaccaaataagaattgacaagatcaatgaataaggaaaaagaactgatcgacaaactgatcgatcttgcttttgcagaagatataggtgatggtgaccataccaccctttcgtgtattcccgctactgcaatgggaaaatcaaaactactgatcaaagaagccggtgtactggccggaatcgaagttgccaaagaaatcttcaaccgtttcgacccgtccatgaaagtggaagtgtttatcaatgacggcaccgaagtgaaaccgggcgacgtagccatgatcgtagaaggaaaagtacaatccttgctccagaccgaacgcctgatgctgaacgtcatgcagcgtatgagcggtatcgcaaccatgacccgcaagtatgccagacaactggaaggcactcacacccgcgtgttggatacccgcaagacaactccgggtatgcgtatcctcgaaaagatggcagtcaaaatcggtggaggtgtaaaccatcgtatcggtctgttcgacatgattctgctgaaagacaatcacgtggattttgccggaggcatcgacaaagcgatcaaccgtgccaaggattactgcaaggaaaagggcaaggacctgaagattgaaatcgaagtacgcaacttcgacgaattgcagcaagtgcttgacttgggtggcgtagaccgcatcatgttcgacaactttacacccgaaatgactaagaaggcagtcgatatggtagccggcaaatacgaaacagaatcttccggcggtatcactttcgatacccttcgcgactatgccgaatgtggcgtagactttatctctgttggagctctgactcattcggtgaaaggacttgacatgagtttcaaagcatgctgaatctataagtgatgaactgataataaataaacggtgaacagtgctgttgctatcgtgctgcagctgttcaccgtttattatttacgaatcacatttctttaacttcttttagcaaaactctttgcagcattcctcaaatacttgcgtctaaaggataaaaacggcgcagacatacgttcgatttaaaaaagacaattggcattggaaaacgagatagaactgataaagggctgtcgggcaggacaggattcagcccgaaaggaactttacaccctctatgccaaacaaatgttggcggtatgctaccgctatacgggcgatatggatgcggcgcacgatgtactgcatgacggtttcatcaagatttttaccaacttctcgttccggggtgaatcctcgctttgtacgtggatcacacgggtgatggtgacacagtcactggactatctgagacgggagaaacgagtcaatcagttggtagtgcatgaagagcagcttcccgacataccggatatttcgtcgtcgggaggaggagcagggatctccgaagaacaattaatggcgtttgtcgccgaattgccggatggttgccgaaccgttttcaacctttatgtgtttgaagagaaatcgcacaaggagatagccgggatgcttcacattaaagaacattcgtctacttcgcagttacacagagccaagtatttgttagcaaaaagaataaaagaatatagaaatcatgaagaaagaaaatgatgaaataaccgatctgtttcgcactcgtctcgctgatgccgggatgactgttcgggatggcttttgggaagagctttcgcaggatatccctgtggcttgtcagcatcgccgtcggttgatattcttccgtgtggcagcggcagcatctgtgttgctggtattggctgcatcctcagctactttctggtatctctctccgaaagaagagatggaggaggcgtttaccaaaatcgtggtggcgaacagcggaagaatggatggagatggtgtacgcgctaatcagttgccgacggcaatggaacctgtattgccgaaaccggcacctaaatcattcggattattatcgcagtatccggaagagggagactcggtttccatttccttctccatgtctttctctttctcggcaactaccaccacgggaaatggcaaccgatacggcaaccaaggtcgcaacggttattggcaggcgaataatggtaacacagaaccatccgccgcacaagaagaaaaatatactaccggtacacctgctccggtggaaaacgtaaaaaaacatcgctgggctttgaaagcgcagatggggacggcacttccggcagaggacggtgcctacaagatgccgatctccgcaggagtcactgtagagcggaaactgaatgactatctcggaatagagaccggactgctttattcgaatctgcgctcggaaggacagcacctgcattatctgggcatcccgctgaaagcgaatattaccttgatggatacaaagaaaatcgacctctacgctacggtaggcggagtggcggacaaatgtatagccggtgcgccggacaacagttttaaagaagaacctatccaactggcagttactgccggtatcggaatcacttacaaaattaatgaccgattggcggtttttgccgagccgggtgtttcccatcatttcaagacggattcgaaactggctacggtacgcacgaaacggccgactaattttaatttactttgcggacttcgcatgacgtattaatccttataaaaatgaaaaaaacacttatgatgctgtggatggctgttagcctgatggtatccctggtgggatgcagcagcgaagaaatggactatgagaatcccgatgtaaccgtttttgtgaaacagctgaaagcgggtacctataatatgaagaatgaaaaaggggtcgtggaagttcctcatttcactgaagaggacattcccgaactattgaaatatgcggaagatctgactattattccttctttcccgtcagtctacaatacgaataacggtaaaatccgtttaggtgaatgtatgctttgggtgatagaatcgatccgtcagggaacagccccgtcgttaggttgcaggatggtactggcgaatgccgaaaattacgaagccatctatttcctgaccgacgacgaagtgctcgacgcggcagcctgctatcgtcgatggtgggaagggcggaaatatccgaagacgacctggacgattgatccgtgctacgacgagccgctttgtggctcaggataccgatggtggtaaaaaaagaaaaatccttcggtgtataaaaactaaaaaacatgaggcaacgtttatttgtatcagcagtctttgtactgccgacaggggcgtgctatgcccaaaaggaaacgaatgcgctcatgcatgatgggggtacttgaggaatatagaaaacagaggtagaaagatgagtgaattgataaaacgtttgataacagctatgacactgtgcctgacagctttgcttgtacatgcgcaggaatggacgaaggaggattccttgcgtctgagaaagttgctggacagtgatcaggagctgaatttgaatcaggatgcagtcaggcagattgatttcggcagcgctgtcggtactccccgcatgtcggtggaaaagaagtggatgctgcccgatgagtcgcttcccgaagcattgcctaaaccgaaagtggtattgagtctgatgccctataaggcaaatactccttataattgggaccccgtttttcagaagaaaataagaatggataagaatacctggcgtggagatccgcattacgaaatgcgtcatcaaaggtcgtacagcaactgggcgcataatccgatggcgggaggagtccgcaaatcattggaggagatacgggcgagcggggtacgtttccgtcagttgagcgagcgggcgaatggaatgatggttaattcggtagtgatggatagtccgattcctttgtttggaggcagcggcgtgtacatcaatggaggaactatcggaggacttgatctgatggcggtttttaccaaaaacttctgggataaaaaaggaaaagaacgtcgggagcgtacgttggaagtgttgagaacctatggcgattcgacgactgtactgatcaatcgccccattgaacagattgcccgctgaaactgttttattaaatatggacatgtctcatgttccatgttatcagattagcacattgaaaaacgattaatttatgaacagaattacttctcttttcggtattcagtatcctattattcaaggtggcatggtgtggtgtagcggttggcgtctcgcttccgcagtaagtaatgcgggaggattgggactgcttggcgcaggctctatgcatccggagactcttcgtgaacatatccggaaatgccgtgcggctacagaccgtccctttggagtcaatattcccttgatgtatcctcagattgaagaaatcatggcgattgttgccgaagagggcgtcaagatcgttttcacttctgccggaaatcctaaagcatggaccggatggctgcacgaacgtggtattatcgtagctcatgtcgtttcctcttcccgtttcgcgatgaaatgtgaagaggcgggagtagatgcggtagtcgctgaaggtttcgaagccggcggacataacgggcgtgaagaaactaccactttctgcttgattcctgcggtacgtagtgcgaccactttgcctttgatcgctgcaggaggtatcggtacgggagaaggtatctttgctgccatggtgctgggagcagaaggggtacaaatcggtactcgctttgcgttgacggatgaaagttcagccagcccggtcttcaaagaatattgtctgggtttgggagaaggagatactaaattattattgaagaaactggctccgacacgtttagtgcggaataatttccgggatgctgtggagagggctgaggatggcggtgcttctgccgaagaattgcggactcttcttgggagaggtcgtgcgaagaaaggtatctttgaaggggatctggaagaaggcgaactggagatagggcaggtgtcggctattgtttcccgtcagcagtcagtagcggaagtcatgaatgaattggtggaggctatgcagcgggcagcggagaagaaatattggtaaaaaaacaagttccgaagtagtgggtttggaaaacctgactacttcagaactttactacttcagaaagttggctgcttaatcaatttataggtttatattttcatattttagatcgaatacatccgctactgctttatataccacttttccttccactacattcaagccgagtgctagtgccgggtcgtctttacaagcttttttccatcctttatttgctaaagcaatgacataagggagagtagcattggtcaaagccagcgtagaagtataaggtacagctcccggaatattggctacggcataatgaacgataccgtctatcacataggtaggtgcactgtgggtcgtggggtgtgacgtttcgaaacatcctccctgatctatcgctacatccacaagtaccgtaccgggctgcatcattgcaagtatatttcgggtaatcagatgaggcgctttatcccccggaatcagcacggaaccgatgaccagatcaacatccggcaattccttttttatccttaattcggatgcgtacagcgtcttgacatttttcggtaatgtctcgctgagatagcgcaggcgtgacagattaatatctgcaactgtaacatccgcacccattcccgcagccatctgcgctgcattacttccgacaataccgcctccgagaatcaatactttggcaggctttacaccggggactcctcccagaaggataccttttcctccttgcggcttttccaaaaagcgtgctccttcctgaatggacatgcgtccggctacctcactcatagggataagcaggggtaatgaatggtcttccttttctacagtttcgtatgccagacagatcgacttattgtcaatcatggcaagagtcagttccttatcggaagcaaaatggaagtaagtgaacaataactgtccttttctgatcagatggtattcgggcgcgataggctctttaacctttacaatcatatctgctgtggcatagacatcttctattgtcggaagcacctgtgcaccgacagacagatatgcttcatccggaaaaccactattgatacctgccgtatgctggatatatacttggtgaccttgcttcacaacttcggcaactccggaaggtgtcatgcctacccggttctcgttgttcttgatttctttgggtactccgatgatcatattgttatatattaaaggtttaacatggaccaatgtacgaaaaatccccttacgttgttattcgcaaggggatgtttaagagcagaatgcttatatataattcggtcaatttaataaacccggatttgcagcaatagcactttgtggaatgcgtagtgtataacgtgaatcatcttgttctaatagataagcttgtccgttcaacactttttcaattcgtggacgggtggtacgacgtagatcgaaccaacgatgaccttcgaaagcaagttcaagagcccgttcttccagaatttctttaattaaatctgcttgattcatagcgtccacagcttttttcttttctgcataaccttccggagtgtatcgcttttccatcaattgtagcaggcgggtacgagcttcgggcaatttattcatttgtgcagctgcttcggcagcgttcaaataaatttctcctgtacggaaagtacagttatgctctgcttttccgctttttttcgagatgtacttatctccacttaaactatagtatttgttccggcggagatccttattagcatcatatttttccatgaacgcaggtatcaatatggatgctgaagtaacgtcatcattgaaaaactcataagcagtaatcatttctgctgatgtataattattgggaagtttggcttccggatcattgaggtcttctaatgtggatttttgaactaatatgcgttctgccgcatcataggcttctttccagtttcccatgtacaggcgtacacgtgattccattgcatccacagatagggtggagaagcggtaagcatatacggcttcccattctttttgatgcattaagccgcgggccgattctatgtcggatagaatagcagtatagacctcttttacggtgtttcgtggcagtaccacttctagatcaaggtcccattttatgggaatggatttggtctctggtgctccctctttagtataaggttgtccatataggttagcaagaataaagtgcatgtaacctcttaataaataagcttctccaacgagttgatcaatgtcttcctgactgccttcttttatattatctttatttgctattatagcatttgcataataaatcacactataatatactgcccagccaaattcccgggttccatctttgggactcatatcattccacttttcaatctctgagtagaaattttgagaattactgttatctgttaccatagctatgtctgtgcgaaattcagtgacggatttgtcgatgagttttagtccgtaagcggtagtcagtaaagcacgatattctgttagtgtagtagggattacttgtcctacaggttgaatatccaggtagctgtcacatgaagatagcaggatgcttcctatgacgttagaaatcctctctcactcctctcactttttaccttttctttctccaaaaagacggcgggaaatcggaaaaacacaaccgtcttttttcgatttctcaccgcattttcaaatcaacccaccaattgaagcagacttcaggaaatatttgttatctttgatgtgcaaaagatcaaaagaatcagatatgggcaacttgatgcgtaaacttcctattggaatacaaacctttgaagatatacgaaggaagaatatcttattgtaaagatcggagtggaatttagttcagaaagccggaacttaaaccgttggttaatagagactattgagtaatagaaacccaagtggcggcaatctgcaacaagtttccatccagatttccgccacttttttaattcaaccgttcagcgatggaaacagattatttaaaatctccctccgaataatctgaaaactccccggcacgttctttcttctcatacgagaccaacgtttcgatactaagcgctttcccgttcttagggcttatgacatctatcacacttgacaaggaccggaacgtctgttcgcaattcgcgtctccattatacgtcaacctcccccggtcaatagcacctagaatgacagaaatgtaccgtttcggatctccccgatattcgataacagtgggcgtcatttgttcttcttcccgaatcagttggacgacaattcttttttttggtcaatcagctccaacagtttttcactatgcacactgatttgtgcatctacttcacgaagttcattcttcaatgaacaaaacaattcatcactcaatgaattttccataaaaacgatttttattaattataaaaaagccattccggaaagcacagctattgcctgcttcccgaaatggtgactaataccttcaaaaacaatgactctatttttactttaatgtactcaatttatttcacttcttttctctcctgcattccaaaccaacaaagcaaacactactgaaagcaaggctgcaccaatccaaaaccaattgatatatgtaaaatcgtaaacttctactccattttgcaccgtcttctgaccttcgatcagaatgccactcatcacatcctgcaaaccggctcctatataactcgctataccgacaactcccaaagcggctcccgaagcattgcagggagcaatatcgaccgccatcagtcctcctaaaaaacaaatcagcactccaatgcccaaaccgaagagcaccatcgccaaagcatccacccaaaaatgtacccccggaaccaatagaaacaaacaaagagcagacacattcattaatccgaatatcaaagccggaacattacgactgccagcaaaaaacttatctgaaataatacctgagaaaaccgtacctacaattccgcatacagaactgatagatataataaaactagcatccaaagtagaataacctttttgcgcttccagatagaaaacaccccagctattgactgcataacggctgatatacataaaagcactggataatgcaagaatccaaatagcaggattcttcaaaactgctttctgagctttattgaattcctcggtttgtttaccggaaacggaatgagcatctgacgtcccccgccgatctagcaaaaagccctgactttgaggcgtatcacgcataaaagcaagcatcatcagaaaaccaagcaaaccaatcactcccgcaccgatcatcccataacgccatcccatccaactgaccagcaaagcgatggatataaaagtcagagcttcacccaaattgtggctggccgaccaaaagccataaaaagtacctcgctctttactactataccaacgagtcagcgacacaactcctgatgctgcccccatcgactgaaaccaaccattcaacccccaaaggagaacaaaagcaaagaaggaattcgtgaatcccagacataagttgatcagagcagaacacaataatccggtagacataaaacgctttacattgctacggtcagcaagaaagccattggtcagcttaccgacggcatatacgaaaaaaaggcaggaaccgataatccccagttgggtttcggtaaaaactccgtcttctacaatcggtttacggattacattcatactcaaacgacaaacataataaatgccatatccggtagtggcagacagaaaggtagcccaacgaatacgcttgaaacggacagagcgttccgaatcagtctctcccccggacaccggaggagagattttataaaaatccaatagtttaaatcccataaagaagtctatattttaatgatacgcatcttgcccgttttcactacgcttcttacgcgattgcaaatattccagcagataggcagtacggtctgtctgaatgatggccgctccgagtgtatcgatcagataaccatatccttcgtccggattctccaacgatttatcatcatcatgtccgccagccatcgtatcccacaacgtattataccagattttactttttcctttcaacttcgtttttacttgcttggggacctggcaggtatccgatacaaatagaagttcaaaagctacgggatgcagctccgtcataaaatcatccagttgcttcattgctcccggcttatccaaatgaatgataggcatataaatgatacggtccagatatttacctaagtcgttctttacgtctgccacaggcttggaacctttcatgataatctgatccactgttcccgtcttttcgaggatggggaaaatctcgtcaaatatcggatatgctttatccagattgaccatcacacgacctttggcaacccataaagcctcttccaaagtaggtacacgatgcttggttttgagtgccgctccattcttcagatagagtgtccggatagaatccaatgtccattcggctacctttccttttccggtagtcgttcggtccagcgttttgtcatgcatcaggatcaattgaccgtctttggttttctgaacatccagctccactacgtcagctcccagacgaatggaactttcaatagcggcaagtgaattttcgggtgcgtaacgccagtctgcccgatgagctacaaccgtgatttctttattgtcagggttcgttatcttcgcataaatggctttcaccggttcgtctgccgacaggcagaaaggaaatgcgaataagattcctatcattatatatttcttcatatctatatgtactattatctgtatcctttagactttaaatatttggcagctacttcagcatagtctgtttgcacaatgttgatgcgtttgttaatcattcccaccaaaccggagtagttttccgacaacatattggtatcattcgctccgacaatgttggagaaaagaagccagccttgatctttaatctcattaaccatcgttccacccatagcgtctgacgtagacagctgcatcatttgtacattatcagtgtaggatgaggagaagtatgtgatatcatcggcggcttttgccatcgggtgcaacagcaaactactgttggctgtcttcaaatcaaatgcataattgcgattgttggatacatacagcaaagtggaaccttccatatccaattttttaagcaatgcgacgatcgtatttaccgcaacattcttgttgacaatatccagattataataaacttttccttttcccttcttcatcgcttcctccaaagtcgggattcgttcgccagttatattgccggatgcatctttcagataaaattgttgtaattgctgataagtaaagtctcccaccgcaccgctaccgtttgttgtccggtcgatggtgttgtcgtgcatcaataccaacacaccgtcagaggtcggccgtgcatccagttcgatcatctcaactcctgctttgaccgagtgttctatcgcaggtaacgagttttcgggaatcccctctttcatccctttttgggtatttccacgatgcgcgcagagccacactttataagaggtgctttcaaacagactctttaaatctgctttcaaattccccgtcataggcaactgtcctccttcttctccaccgggattctctccattccctcccgattgggctccggagtgacgtctgtccttccctttcatcggccaggcagaggttgcggccccggtaattccctcatcttccaaagctactaacacgctctttgtagggtccaccgtattggtgactccgatataaatcgctccatccggtccgatggtaggcgaactccagattttaccgattcccgcttcccaatctccttttaaaggagagtcactttcactaatcaacgcagcaaggtcttttttcagaatcaattgttcatccgattcttccggtttaatgatataataattgccggactgggtgccgaaatgtatgtttcctgcttgatcaattgccgcacaaccgcttacatcttccgcaatgccgtaatgccattggatagctcctcccggagacaaagagatgattcctccggttgcttcccccggagcacgtttcactgtaacgataatgcttccgtcgagtcctatcacaacaccgccttgatccagcgtgccgacattgcccaaaggagtacgccacttctccactccatcacttcccatagcaaatgcgctacttcccattcctgcaaacgtagctgttccgtaaatagtaccagcctcatctactgccggagaaccgttcatattttctgacggcttatcatcgccggagctaaatacctgccaagcccacattacatttccaccggcattcaacgcagaagcagaagccccgaacaatccattctttccgccaccccaaactaaagtgttgtttgccaatactattccggcagatactcctccggaaggacctccggaattatccgcattcgctacgtatcctacccgatagccggtcaccttatctactgcaagcactgatcctgtagaaccgccattacccatatatacatgattctcaccaatggcacaggtcaggtaattgatacggggtgtggaagcgtttcctttattccagaagcccttttcagcgtcacctgccaccagccatttcttactcccgtccggatttattgcatacacacgtcctactttgccactggtgtctcctgttcctacgtagattgttccgtctatatcaatgcttggagtagtatgcgtatttccggatggtgcatcgccgtcagcagatgtccaaaggtcaaattcccaaagctggtctcctgtcgctgccgaaaatttacgtaaataatgatcattggaagtcatatacaccccattatcatcactgacagccggagctgtagaacgtacttctcctaacacatgaccgcctacccatttcagttttacatttcctacttcaggcaaaggctccgaatcaatggtcaacaatttgtgagccatcgcataagtgccttttgcatccttcacatgaagagtcaccgtataggcaccgttcgtttgataggtgactacgggattggggtccgttgaagtctttccgtctcccaaatcccactcataagtgtagtttccttctccgcctacggtttcattagtaatgcgaacttcatctccgacataatacagcgacttgtcaaaagagaatttggctgttaacgcattttctttccagtcatccgaacaggctgaaaacagcagcaagcagatgcaaaacgttgcaaatatttttatattcttcataatctgttctttcttaatttattaataaccatcgttttgaggataattttcggctcctgccaaatcgcgttccgactggggaaccggatagtacattaaatagtttcttccgttcagcgaagtaaataaatccaaccgattggtcctcttcaagtcgtaccagcgctgtccttctgcatacagttcacgatggcgttcgtccagtatctgattctgaaactcggtgtcgctcatgcttgaaggtaatgagactgtagcataacgcttattcataaactctttcaaggtcgacaggccgttcgttgctcccagtgcttccgctttaatcagatacatttcggctacacgagccactactataggagtttgagaaggttgttcgttggtcacaaactgcccggtgcttccattcggaaatttgatgatccggctattgtctgccccaaagactgctttggcacgaatatcctgctttttgactgaagtatcggcataaagatgactatagcaatcggcagagggagaataatcccatgtcgggtcaatatcattaacagactgatagaaaagtaacaatcccgtgctgcgtttattggccagagcaaaaatcagttctttgctattactattggagatgaaagcattagcatattcagctgatgtggtactcaatgcgaaattggacttagtaatcactctgtctgcataaatagccgcattcgtataatctttcaaggccagacaaacttttgcattcaatgcatcacatacacttaaagatacgtaaaagcgatcggtaaattccggaagtaagctctctgccttgcccaaatcttctttaataaaattccacacatcggcttcgggtgagataggcactacgtcgtaagtacgcttacgtaaaataggcgctcctccccaacgggtgactaaatgataataaatcaatgcccggaaataatagccggttcctccggtctgtttcaccacctgactgtctttattggaggatgcttcgtaggtctccaccaagaaattgacttgctttaaggctgtgaaacatttctgccactgccccaatacatctttggagctcggagccatcgacatcggatcattcatggaaaatcccgggcccgccttgaaattctctcctttcacatcaccgtccatatagaacttgaaaaccagttcttccatttcagcatataccccgttaagcaactttgtcaagtcggactcgctcaatgcgtcttgaggtatcttgtccttcggtcgcatttcatccagcatatttgagcatcctgtcatccataaaagacaaatgccgcatagtaaatagttgatcatataaaatcgtttcatactcgtctgtttttaaaagtttagattcaaaccaaagataaatgttctcaacactggttgcaggccgaaatcaactccgtaattggagtctccgggactgcccgagaaagaagtttcaggatcgtaacccgaatattttgtaaaagccagcaagttgtctgccgaaacgtaaaatctcagagagttcacatgaattttcttcgtgatggattccggcaaggtatatcctaatgtgactgttttcagtttgaagtaggaagcatcttccagatagcgggtggatgtctgaacattgtagtcataatcatatccggtatgcacaccgatccttacaggacggggaatcgagttgctggtgccttcaccgcgccagtatccattggctacctccttactgatattaaagaactgttctacggattctccacggtcgcccacttttacattagacagtgccagacctaaatggtcggtaccttcggaaccattgacaccccgccatgccgccatcacttttccacctacggaaaattgcccaaataatgacagatcaaaacctttgtatgagaaattcgaagtaataccaccgtaaaagtcgggaatagcttttcctacattcacacggtcagcgtcggtgatgtcgccatcttcattgtaatcaaaatatcgcacatcaccggcacgcactcccttggcataaagtttggcgggaacttcatcgtcacgctgataaatgccttccatcttcaacatataaaatgtactgatgggttctccgttgatcaaagcatgcatggaaccacccaaaaggttactcccgctactgggtacaacgtacatttcacttccttcaattaaagagagcagtttgttctttacgaaagaaatattacctcccaagtcccatttgaattttccggtgagaattttgccgtttaatgccaattcaagtcctttattctccaacgaaccgatgttagactgtagagtggtatatccggtacttgcatttacaggtttcttaaacagcagatcggtcgttttctgatagaacatatcaacgttcaaggttaaacgagactgaaacatttcgatatcaaaacctatattgaactgacttgctttctcccaagtcagcgcacgtgcgtcctgtgaaatctggaatccggcagagccattgtaggatgcgcctcccgcactaatgagcgacaacggagcataattgctgacacctgccatgctgcctgtcataccccagcttaatctcagtttggcatcattgacatatttgtttttgggaaagaagccttcattggaagctctccatgcaaaagaagccgagggaaagtaaccatacctcttattcttcgcaaagcgggaagaaccatcgctgcgtaacgaggcattcaggatatatttattatcccagttcagggcgattcgaccaaagtaagactccaaagcgtaggaagtataactgatatctccggcatagatgttcggtccggcattaatgagatcgaaactggacgaaggataggcaccattggcgtaattatcactctttgctccaaactgttcgtaagtgtatttctcgaaagagtgtcctaacataactgagtaaataagtttattccattcgttattgtaagagaaaacattatcaatcacataacggaaactctggtctttctgttgagccaaagctccccaaccactactgtttttacgggcatcgtgcttatccgataacttctttgaaacattatccaaaatgccgtacgcactcactgtcggtgtatatttaaaacctttgaagggggtgacgtctatactgaatactcccgacaactgatatttctttgctacccagtcttcttcatttattaacatgaggggattatggcgcagaatatccgttccattcactttataggatgtcccgtcttctttgtaaggagaataccaaggttgttcctcacgggctgtacgcaatactttcaaactggtactcgtttcttccaataagtccgaacgacttgccgaacctgccagattcatatttagtttgaagatgctgtttattttatgtgagaacttagcacgcatattgtattggtcatacttactcttattcaaatagccttcctgagtattggctcctaaggaagcaaaaaaagtagtcttttcatttccgccggaaatgctgatagaaccggcacccgtctttgagttctttcttgaaatctctttcacccagtcggtttcctgaatctgagaaggaatatacagttgcaggttggttcccatctgcacattgtagttatcaatagcagcctgcatagtattcatgtattccgttgaattagccatctctatatcactggcaagggaggcaaagccgtaacggccggatacttcgatctttgttttcccctgctgccccgatttggtagtgatcagcaccaccccggcattggcacgcgaaccatagattgccgctgccgacgcatctttcaacacttccatactctcaatatcattgggattcaaattcggatatttttcgctggggattccatccactacatacagcggtgaacttcctccgctaacggaaccgataccacgaacagttatattgggagtttcacccggtgttccggaggcagaagatatattcacacctgccacacgaccttgcaacatcttaatcggattgtaatcatttccctgatctatattctccatcttcactttactgatagaggtagtgaccagcttctgtgactgaactccataacctactactacgacttcatcgatcatcttactatcttcctcaagtactacctttaccaatgtctgatcggtagtagcaagattgactgtcttgtaaccgatataagagatggtcaagactgctttctccggtacgtcgggcaatgcgaacttaccatcaaaatccgttattgtcccgtgagactcacctttaatcacgatacttgcaccgataatgggttctccgttggcatcgacaactgttccggttacttttttcgtcagttgtttactttgtgttttacgaatcaacacaatgacgttttcctgttcttttttgtaagtcagttccattccttccaaaagacgtgtcatggtctggtcgatcgttacatcccgaacgttcaatgaaactttccaactcaattccggcagactctcactgtagaaaaacttgtaattactaacttgctcaatcttttttaatgaggctcttaacgagatgcctttcaaatcaaccgttatttgagaataagcggtcaaagagatgctcatgaacagtagcagacaaatggcccgtaatgttctccagttcttacttctccctgctgtagactgagggagtttcacaaagggtgttctgttttccatatatcaaaacttttaagttgtttgacaggtataccgactgctctcccctttcgtccaatcggctatctatctttaactcttgttaactaacggttcttcataaattaaaaagccattccgggggaaaactcaggaatggctatatctaatttcatgataaagatgcttatctacttctctttcaagacaatgaccgagccatccatttcataataaaaaggcgaagtaagcatgagaatattcaaggcgttctgtatgccgccactaggaatcgttcccgtaaagtattctttaggaagtttattcgaatcgaaacgtatctccacatcataaatccgtgaaagagttttcatgatgttttccaacgattctttctcgaaatagatatttcctttcgtccattcaatataatcattgggatgcacttgggtagcaacaagttgatgagtggttttattgtattctattttatcaccgggcttcatcatacgcgaagtttcctgagtgtaaattcctactttcccttccaacaaaacaaccgtaatgtcttttgcatcttcataagcagatacattgaaggaagtccccaatacctttacttccaaatcacctacctgcactataaacgcatgtttctcatcaggagcgactttaaagtaggcctcaccattcagttgcactctgcggactttctctccaaaattattcagataactcaattgagaagctgagttaagcactacattcgttccatccggcaattcaactgtagctttatcacctttatctgctttgacaataaaaggcgcactggtcatttgcgacgaatcgatcaaataataagtgaaaaaagcaatacagacaggtaacaaaatagcagccacccacctccaaggaatcatagggagagttctcacgcccttcgttctcggtgacgtatgtttcagtgttccttcttttatccgtgcaaagagtttatcacgcagtatcggatcaatagcggcatccgacttggtaaactcctgttcccaccagttttgcaactgacggtcgttctttatccaatcggacaactcctttatttcagtgtccgctatatttccttcgaaatatttttcaatcagctctttataatgtatcttatccatcttcctacttatttacaggtatacattttcatcctatctgccatccaaaagcaaagattacaattacatttcattaacaaaaaaaggcaaacagaagcgcaacgattttatcataatgcttcattaactgctcacgcataaacttcacggccaaagatagttgcgtggcaactgtactttcggaaatgcccatcatctccgctatttctttatttgtataattttgccttttgctcagaataaagattttcttccgttgcgccggcaattcttcagccaaagaatcgatatattcattcaagaatcgcaagtcaatactttcttctgtctgggagtcacggtctactccagtatttttcaaatattcattgtaaacatactctacagtctgacgctgatacatattcattaataaattcttggcgatggtacaaagaaaagaaataaatgaagactccggctctactcgctcacgtacttcccaaacacgtataaaggcagactgaactacttcttcagccatatattgattgccggaagaaattcgcataatgaagttgtataacttaccgctatacatattatataatctttcaaatgcttgaaaagagccgttctttaattcggttaataaacgtttttcatttatagaatccaccatagcttagaattttgcaacaaaggtatgttaccatcggtcagaaacaggtgacaatgatattaatattttctcagatttccgatttttcagcagagtttctgcacataaaactttaaaagcgatattttaaccgtcattggtaaaatatcgcttttaaaatatatagctcaactatattgactaataagtaagtcggatacccgcctgaatattgaagttgaacggattctccttacggatggtctgtacatcagaaccatcatcaaagaaataagcaacaccgggttctacgtatatacctacccgtttggtggcattaaactgtgcgccgactgcaccggagacggagaattgcaaaggtttcacagtttccttttccgtgcccagcttaccataaacacatttctcaatcatacctccaccggatacataaagagtaaacagtttcttatcaaggaagttccagttcgcttttaacgggatacccagataatgcagtttctgttcggtcttctggtcgctgtccgcaaactttgcatccgaagaaagcaaggtgtaagtcaatcctgtttcgacagagaaccctttcgccagactcttgcggacagataatccgaaggagataggttgatggtgttccatatcgaccacctgattggcctgacgcaaatatggtactccatcttcaaagaccaattgctgatcattgggtatgctcagcagaccgtttgataccgataccatgctcacacgggacatataagaaggaatgcccgatcccaactctgtagaagcaccaccggagttacctaccgaaagtcccatcgaccacgtgcctttctgcgaagatgctttttctgccggaatatgcagtttgtctctgctggaaggacggcgtggcttatttctcggttgttccgtatctgcgggcttatgccggatggctttcgtttcttccaccggttccacttcttctttttctttccggtcgccggtctgagcgttcagctccgaaggttgctcttctttcttcaccggttcgtcgatatttgccgttggttggggaatgttccgttccgctttcgcgatgcggttcttcactaccggacgcactaccggttctatcgttgttcctgtcatatccggttgctgcgcatccggcaaaacatccggaacagaggctaacgccggagtcttggcatgacgaatttcatcagcagcaggagtcccgaggaaatacaggctgaccgatgaccccaaagccaataaaatgacagccgcagcggctaccgtccatttacgataaggatatatcttcctctccacaggaggcataagttctttttccagttgttcccaaccggaagcaggaagcggctccgagtaatccccgagcttctccttcaacttattcatccataattctttctcttccatatctctacctatccgttattcattatccattcttttactctcttagccaacacgctcttcgcccgaaataattgcgaagccgatgacttctcattaatacctaacaactgtgctatttccttatgcgatttttcctcgaaggtgtaaaggttgaacacggtacggtatcctgccggcaactcttcgataaatcgcatcaataccgcttgcggaatcatctctacagccgaagcgtcgggttcctcgtaatcttcgggtacttcttccaaaggcgtagactgactgattacatcactcttgcgaagatactgtaaagcggtattgaccatcactcgttccatccaggcccgcagtgagccttcaccccgccaggtgaacttgtcgaaagaactgaatatctttataaaaccatcgtgaagcagatcctgagctgtatcacggtcgccggtatagcgcagacagacgcctagcaaacgccctccataatgctcatacaattctttgcgggctcgattatttcccagcctgcattgttccgacaactcaaattcttccatttgcttatacacgtgtttaccttataaatgcagcaaagatagaaatactgcacagagagaacaactcttttgcaacttttgtttctttaacagatccaaatgcaatattttctccccccttgcattttcagagtacaaagcaagtaaatagtactcattaaaaaacatttttatagtatatgaagaaatttaaattcattgcatttattattgctgttatgaccacaatgccgatacttcagtcgtgtctggatgatgatgactcctcatccgattcactggtcatcagcaccatcaatctgatcagcccggatagcaaggatttctatttcactctggatgatggaaaaacaatgttcccgagcaatggaaacggatggatcagtgacaagaataaagacgggcaacgcgcctttgtgatattcaaagagctggaagaaccggtgaagggatatgactataatattcaggtaagagaaataaaagagatcctgaccaaagaaatcgtgactatgggggaaggagaaaatacggaagagaagatcggagacgataaaatcaattctacttatatgtggattacccaagacaagaaatatctgacaatcgaattccaatattacggcacgcatagcgaggacaagaaacatttcctgaatctggtcatcaacaacaaggaagctgaacccgctgccgatgatgccaacgatgagtatatcgatcttgaattccggcataacgacgaaggcgacaccgccgaccgtctgggcgaagggtatatatctttcaaactggataagattcaagatcagatgaaaggcaagaaaggactcagaatacgtgtcaagaccttatataacggggaaaaattctatgaagtgaaattcccctcatctaattaaatctagtaattatagaaacactctttttattataatatataattacgcaaaagagggcgacagttgtgaaactctcgcccttaattttatcataaagtgatccgtttatttcttcttattatttcttttcattcttgtcaccgaaataattccagacgagcgcactgacagccgctcctacaaacggcgctacaataaacagccacaactgcgacaacgcttctccaccctggaacaatgccggaccgatgctacgtgccggattgacggaagtacctgtaatagggatacatacgatatgcaccaataccagagaaagaccgatggcaaggcctgcgaaagctcccgcccctttcttcggatcggtagaccccagcaccaccaatacaaaaatgaaagtaaagaccacttctgcgatgaatgcctgtagcatctcgccgtcaccaaagccgttggaaccggtagccgtcggtccgtcatgcccgccggtggtcaccagggcataaagaatagccgaaccgataatcgctcctataacctggaaaagcatatacatacccgcatcttttccattcatacgacccgagaggaatactcctaacgtaatagcaggattgatgtgacatcccgaaatacctccgatagcatacgccatcgccactactgaaagtccaaatgccaaagcaacgccgaccgttcccacgccggctcctacagtaccagccatactgccggcaaaaacagcacttccacatcccatcaggacgagcaccatcgtcccaatcatttctgcaatgtattttttcatattactaaataaaaaatggttgattctccaaatataaggaattaatacctagattcaaaatgtatgtgcctaattattactatctttgcagcatttttgaataaaaccaccaaaccataaaatgaaaaaaggacttttttatgctatactggcctctgtattatgggctatcgtcaatccgtttatcaagcaggggctgagttacgacttttcgccgatgaactttgcaggaatccgctttaccactgtaggtatcattctttttgcttatacctggcataagggaatgtggaaagaaatacgccaacacagcaaactgtttctgaatctgatcctgatcaatatgtttatggggtacacggctttctatttcggagtcgatttcgtcagcggggctatctcttctatcattatgggaatgacacctctgatcaatgtactgctagcccatctgctggccagcaatgaccggctgaatgtgcacaagattatcagccttattgtcagcctcatcggtttgctgcttatcgtaggcatgggcagcaatggcgctccgctggactggaaagggatcacgggaattgtacttctgctgctcagtatcatctttcagggatattccgcgatttcggtatcggaagataaaggcaagataaaccctattttcctgaatgccgtgcagatgttcttcggcggactgctcatctatatgataggattaggtacggaagggtatcattcatttatcggaaagcctgccggattctatatcagtctttctattctggtatttatctcggtctttgctttcagtttctggtttatcgccttacagagtaaaggagccaaagtgagtgatatcaatatgtgcagactgatcaacccgatattgggcgccatacttagctggatcatgctcccgggagagtatccgacattcagtaccgttgcaggaatgattatcatagtcagctccctcattatctattttaagggagctgaaatagggcgatggttgaaacgccatacagccggaagcagtacgcaggaataaacaatattacagcaagtactgaatggattgcagggattgcatttctttgggtactgctgccagtatctcttctttgagtacattgagcaggctatgacggataaaatccctattggtcgcaagcactatctgccgtgtaggacggggaatggcaaacggacgtaccagtttcttttgttcttcgttcagttgcgaaacagccagttcgggaatgaaggtgattccttttccgctttctaccatacgcataaaggtttccatacttcccagatggtaggccatctgattgactttgaccgtttccatctggcagaaacgtacaagctggtcacggaagcaatgcccttcgtccaataaccagagacgttcgcccgttatatcggaagtgcgtatcacgtcgtgcttgaacagaggttctttgcaggatacatatccgaagaatgtttcatagaaaagtgtttcttctttcaggaaagtgtcttccaatttgctggctataattgcggcatcaatatctccggcatgcaatgcctgctggatattctgtgttttcatttctgtgacacgtatatccagttccggatacttttccatcagttgggggaagaagcggggaagtaaataaggtgctatggtaggcaatacccccaaatggaacacgcctgccagtgactgtttctcttcactgattatttctttcacctgcgctgtctgtgccagaatgacacgtgcctgatcaatgatcttttctccaatcgctgtgggacagaccggctgcaccgtacggtcaaacaacttcactcccagctcatcttccagtttctggatcatagcactcagcgtgggctgcgtcacgcggcaatattccgccgctctggcaaaatgacggaacccaacaaaagacaactaacataggaataagaataacaaaagtaaacctatttagatattaaagtatattgagtaaactaattcagttataacaaacgaagttgtcaactaaaaccagtacacatcagcaacttatagtttcctgtcatttcttggaatggaaactgtcgtttcccggtgagggaacggacgttccttttaatggaaacgaccgttccttttaaagggaactggcgtttcctccgaggaaactaacgcctgttgtcttattctaaaaatggttatagttttatctccctaaggaattcatctggctaatttggcacgcaactcttttagtcttttagcagcctgctgattatccactttaatatatcgcataaacgcagatggacttttatgtccggatatacgcattagttctgctgcaggaaaaccagatagatacatgtttgtacaaaacgatcgccgacaggtatgggaagagatcatttcccatttctcatataccctcttttctcgctctttacctttcctgcggacaacttcaatcttttggctcaattttatcttccgccccaactctttgactctctcattaaacatgtatcgtgggattttaggcaaatcataattatattttttaagaatctcgggcacataatcaatcatgggaatcactacagccttgtgtaccttccgctgtttgagatttatattctcattatccaaatcaatatgctcaggacttaaagttgaaaggtcactgtatcgtaatcctgtgaaacacccggtaatgaatacatcccgtatctcttccaattgcttatcatctgataaatcaagttcgtatattgcagccagctccttttcatttagataaatagcatcggtttcctcttctacaactttgaaattctttaggtcaatcggtggaataattccttttactatttgataattaacaaagcctttcaacaaacgtatgatttttcctgcagaattggtgagcagccctacagttccgtttggttttactactttatgaaatagataatccataaactcgttgtaaaatgtcagattcaagttgcggaatgttacaggttgtgatgagtattctttgaaggcggtcagatgcttgcggagtgttcgatagtcttttatttgatctgcagagacggatggtgctttttccactatataccgttctaatgcatcaaacatatctacccgattaggacgcagatcatattccctgttcttttctaattcaagcaagacaaaatcaactgtcggatctatgccgtttactttagcataggtgagaatatcaccgagcttagatgttatcttaatcaagcaggcatcaatttcttcataatggggacatgcacgcttaatccatttcctttttgcatcccaatgttccggtttgatattgtatccggtagagataagcgtgcgcttgttccgattgtaattatatcgaacataaaggacagtagttccctcttgggtaacgtacttgggtttaatatatggtatatattttgcgatggtataatcagtattgcattcgtgttgcaaatttacgaaagctatctgaaatgaccaatatctcttttgttaaagttagaagtcatcaattaatagaccttcattttgggttggtaaggataaaatctgctcaaaaaaggataaatactgctcaaacaacgtcagagcccctattccgtatgttaaaagaacgtttgaaatccaaaaaagaatagattttgtcctttcttgaacacagattttccttgtttcttttattaattccattattttgtgtcatcaagatgagatactatggaaaataaagagtttgttaaagctcgatatttgctagaaatacacgatttgttagccgcttctccataacatttcatcctaaatatgacagtactgatattatatattaaaggtataggaaaacgggtataaagattgcaattattcaaaggtgagatagtattaaggtaaaaagtggatttaaaagaatacttagggcttgtttttttatgaggtaaataagattgatggatggataaccttggatttgaagattaatttaaagcaaatatttatgaagaaattgctagccataatggctctttcagtcggcttgttggcaaatgcccagaccgttgacttattaaaacctgcaaaagatatagtgctacgtgctccgtcggtgcctattatcgtttcagatccttatttttcgatctggtcaccctatgataaattaatggaaggtagtacagagcattggacaagtgcgaagaaacctttattgggtgctctgcgtgttgacggaaaagtatatcgttttttggggaaagataaaattaatctggtacctattgctcctatgactaatgtagaacgttgggaagcagcgtacactaacagccaaccatcaaacggatggcaagaatttcagtttgatgatagcaattggaagaaaggtaaagcagcgtttggtagtcgtgatatggaacgtattcacacagaatggaaaggagacaataccgatatctacattcgtcgcactttcgattttaatgaaccgaatatcgctgaagatatttatctgatctattcccatgatgatgtatttgagttgtatctaaatggggaaaagcttgtttctacaggacttgtctggaagaataatgtatatctgaaactttcagaagaagcaaaaaagaaacttcgtaaaggtaagaacgtaatcgctgcccattgccacaatactacaggtggttcatatgtcgatttcggattgtttcgtgagaaggaaaatgctgttaagtttgcaaatgaagctgttcagaaatctgtagacgtattggctacttccacctactatactttcacttgtggtcctgtagagcttgatgtcgtgtttaccgctcctcaattaattgatgatcttgatttattgtcaactcctataaactatgtttcttatcatgtacgttcattagataaaaaaactcatgatgtacaattctatatggagacaactcctgaactggctattaacgaaagtaaccagcctactgttgctcgtaccttatcaaagaatggtatcagttatgtagaagcaggttcaatcgatcaaccaatatgtgaccgaagaggtgacttgatttgtgctgattggggttatgcatatcttgctagtacgaatggatcaggtaaatcagtcagtttgggagactattacggaatgaaagaatcattcgtgaaaaatggtacattagccactacaaagactaaatggacaactcgtaaagaggaagataatccggctatggcatatgttcacaatctcggttctgtctccaatagcgggaaagaaggattcatgatgcttggttatgatgacatttactctattgagtatatgtacgagaagcgtatgggctattggaagcatgatggcaaagtgactatcttcgatgctttcgaaaaattgagagacaactatcaggctattatggaacgttgtcgcgcctttgacgaacttatttatgacgatgcagaaaaggcaggtggcaaaaaatatgcagaaatctgttcggcatcttatcgccaagtgatctctgctcataaactctttactgataaagaaggtaacttgttatggttctctaaagaaaacaacagtaatggttgtgtaaatacagtagacctaacttatccatccgcaccactatttttggtttataaccctgaattacagaaagctatgatgactagcatctttgagtatagtgctagcggtcgttggaacaaaccttttccagcacacgatttagggacttatcctattgctaatggtcaagtgtatggaggtgacatgccaattgaagaaggaggtaacatggtaattcttgctgctgctattagcaaaatcgaaggaaacgctgactatgtaaaaaaatattgggatctcttaactacttggacaaactatctcgtagagtatggacaggacccggagaaccaattatgcacggatgacttcgccggtcattgggctcataatgccaatctttcagtaaaagcgatcatgggtgtagccggatatagcgaaatggcgcatatacttggtttatatgatgttgcagagaaatatgcaggtatagccaagaaaatggcggtgaaatgggaagaaatggcaaatgaaggtgatcattaccgccttgctttcgaccgtgagaatacctggagccaaaagtataatatgatttgggacaagatgtggaatctgaatttgttccccaataatgtaatcgacaaggaagtaagttactatttgacaaaacagaatccttacggattgccattggactcccgcaaagagtatacaaagtctgactggattatgtggactgcaactatgtctccggatcaggctacttttgaaaagtttataaatcctctctataaatatatcaatgaaacgacttcacgagtacctatcagtgattggcatgatacgaaaacaggcaaaatgactggttttaaggctcgttctgtaatcggaggatattggatgaaagtactagtgaataagaattcaaataatctgtaaaaatgcatacaaatatttttaccaataaaatccaatgtattatgaaaatgaaaagtaagaccaaaagttgctgtcagtacactcaatgggtagtactggctttacttacacttatctttgcaagttgcaaagataatgatgacgcaacaggagattttgatccgaataagcctgttgtcatttctgaattcagtccaaaagaaggaggacttggaacccgaatgctcttgtatggagaaaacttcggaagtgatatttctaaaataaaggtaactatcggtggacaagactccaaagttgtaggagcaaaaggaaaaagcctctactgtgttgtgccagctaaagcttatgatggagatattaaattaagtattctcaacgatgaaggtgaagaaattgcaaatacagaagccaatgagaagtttgtatatcaaaagaagatgcttgttacaacatttctaggaacaatgtatgatggaaacaccaaatatgatttaaaagatggaccttttgatgattgtggtggctttggaggtgctgtttggttgtcctttgatcccaaaaatcacaatcatttatatctagtgggtgaacagcaccctacccgtttgattgactttgaaaaagaatatgtaagtaccgtatatagtggattaagcaaagtacgtaccatctgctggacacatgaagctgacagcatgattattaccaatgaccaaaataataatgatagaccgaacaattatattcttacacgtgaatcaggattcaaagttataacagaattgacaaaaggtcaaaactgtaatggtgcagaaactcatcctataaatggagaattatatttcaattcatggaatgctggtcaagtgtttcgatatgattttacaactcaggaaactacccctttgtttacgatacaagatagtggatgggagtttcatatccaattccaccctagcggaaactatgcatacattgtagtagttaatcaacattacatcttacgttctgattatgactggaagacaaagcgccttaccaccccatatattgtttgtggtcagcagggtgccaaagattgggtagatggagttggtaaaaaagcccgcatgcatgctccccgacaaggtacattcgtaaagaatccagcatacaaagggagcagcgatgaatatgacttttatttctgtgatagagaaaaccactgtatccgtatcttaacaccacaaggtcgagtaacgacatttgctggtagaggcagtaatggaacttccggatataatgatggtgatttacgccaagaagcacgcttcaatcatcctgaaggaatcgtatacgatgaagaaagagaatgtttctttataggtgaccgtgaaaaccgccgtattcgcaaaattggctacgaagaataatacatgattaacacatacatttatatgatgaaaaactttttatttatatgcatgttgttgcttggactttctaccagtgctttggcacaagaaagcattgtagtaacaggtgtcgtaactgatacaaataaagagcccatgattggggttaatgtatcaataagtaatatacccggcttaggtgccattactgatttgaatggaaaatacagtattaaaatgccaccctaccacaaattggtatttacttatataggctttgaaaaagtagaagtattagtcaaagagcaacgaactgtcaatgtcacaatgaaagaagcaagtgctagagagattgacgaggtggtaatcacgggtaccggtgcccaaaagaagttgactgtaacaggtgctattactaatgtggatgtagatgtcttaaaagcaaatccctcaggttctatggctaatgccctggcaggtaatgtaccgggcatcttagcgatgcaaacttccggaaagccgggtagtgtttctgaattctggatccgtggtatttcaactttcggagccagtaattccgcattagttctcgttgacggattcgaacgtagtctggatgaaataaatgtagaagatgtcgaatctttttccgtattaaaagatgcatcagctactgctatttacggttccaaaggtgcaaatggagtagtattaatcacaaccaaacacggtaaagccgggaaaattaatatcagtgcaaaagcggaaacgttctacaatatgctcacccaagttcctgactttgtagatggatacacatatgcttccatggcaaatgaagctaaaatcacacgtaatcttgagccgctatataaagcggacgaattggaaatattccgtttaggactagatcctgatttatatcccaatgttaattggatagatgaattactacgaaaaggttcatggagcactcgtgccacactaagcatgaacggtggtggtaatacagcacgatactatgtatcaggaagctatcttgaccaacaaggtatgtacaaagtagataaagctttgaaagattacaatacaaatgcaaatttccgtcgttggaattaccgcatgaatgtagatatagacatcactaaatcaactctattaaaagtcggtgtttcaggttcattacaaaaggccaatgattcaggagttggcagtgatgctatttggacagctcttatgggatataatgccattatggttcctaaattatattctaatggatacgtaccagcctatggaaatgacaatggagatcgctttaatccatgggttcaagctacaatgactggttatcgggaaaactggaagaataatatccagactaatgtaaccttagagcagaaacttgatttcatcaccaaaggacttagattcgtgggacgcttcggatatgacacagaaaataacaactggattaaccgcagaaaatggccggaacagtggaaggcaaaacgtttccgcgcaacagacggaaccctcgattatgaccgtgtagctgaagaaagaaagatgtttcaagagagcggttccgatggccttagaaatgaattctttgaagcagagttacattatagccgaggattcaaacatcatcatctaggaggaacattaaaatataaccagtcttcaaaaataaaaacggtaggccttggagatgatcttaaacaaggtattgccagacgtaatcaaggattggcaggacgatttacctataactggaattatcgttatttcattgatttcaatttcggatataccggttcggagaatttcgcagcaggacatcggtttggtttcttccctgccatctcaggagcttggaacatagctgaggagtctttgataaaaaaacatcttaaatggatgaacatgttcaaaattcgatattcatacggtaaagtaggtaacgacaatttgggaaatactcgtttcccctacctttatgatattgaaacaatgactaaaaaagatggtgacaaaactgtagacactggtggatacaactttggagattacacgtttgacagatattatggtggtatgcgctattcttctttatcttcgcctaacgttacatgggaaattgcaacaaagcatgacctcggtattgacttctcttttttcaatgacaaattatccggttctgttgactattttaatgagaaacgcgaaggaatctatatgttacgcgaatatttgccggggatagtcggtttagaaagtaatcctagtgccaatgttggaaaagtgacttctgaaggttttgacggacatttcactttccgccagaaactgggagctgttggcttaacaatacgtagtaatatcacttatagcaaaaatgaaatagtagatagagatgaagaaaacaactactactggtataaaatgcaaaaaggacatcgtgtaaatcaagcaagaggattgatatctttagggttgtttaaagactatgatgatatccgtaatagtccggtacaagatttcgatggttataaagtaatgcctggtgatattaaatataaagacgtgaatggtgatggtaaaattgacggtaatgaccaagtcgcaatcggtgcaacgaccaaacctaatcttatttatggattcggaatagctgcaaactggaaaggtctagatgtgaatctgcactttcagggagccggaaaatcaacttattttatcgatggctcaacagtccatatgttcaagttgggagatggctggggaaatgtcctgtcagagatggctaattccaatcgttggatttcagcagatatatctggtgatccagctacagagaatccgaatgctgaatatccccgactatcctacggacctaattctaataactatcagcaatctacttattggttacgcaacgggtcttatctacgtttaaagactgtagaagtagggtatacgctaccaacccagctggtaaataaggtacattttaacactgtccgtatcttctttgttggcaccaatttactcacatggtctgcattcaaattatgggacccggaaatgggaagtacggatggaaagagatatccgctcagcaaaaatttatctttaggaatatccgttaatttataatacacgcaatgacattatgaagaaaatatacattattttatcatttataatagggataggatttaccctcagttcatgttccgattacttggactctgattatctatttgatgagcgtatgtcaatagaagatgtttttacaagcagagcttattctgacaaatggctggcacgcgcatacttctttttgggagataaccatcttctcgatgtagccagtaaaggatatgttcctttctgttttgctgatgacatgtatttcggtgatcgagatgaccgatataaagcatggaaaaacggtgaatataacgaaggaggtttagcaggagaaagtgcagaaatctggaacaaatgttataaaggcattcgccaagcctctatatatttgaacaatatagacatgaatacggaatatacagcggaagaaattgctgacaacaaagcacaagcgcactttttgaaagcctatttctactggattatgttgcgcttgttcggtcctgttcctattgtgccggatcaaggcattgactacatggaagattatgatgcagtagcacaaccgcgtaatacgtatgacgaatgtgtgacctatatcacaaatgaattagttctggctgcgcaagctctccctttagaccgtgcaatacaagaaatagctcgccccacccgtggtgcggcattagctcttcgtgccaaagttctgctatatgctgccagcccattaatgaatggacaaacgcctgctgatattgcttcagaactggtagatgatcaaggtaatcgactgttaccagaagcttacgatgaatctaagtgggcgaaagctgctgccgctgccaaggatgtgatagaattgaaccgttacacgctgtttgtttcttatgctacagacaaaggggatattgcatttcctgcaacgattgctcctccataccaccctgaattctcagaacaagcttggccgaatgggtggaaagacatcgatccgttcgaatcttatcgtgctatattcaacggaacagtcagtgcttttgagaataaagaattaatttttacccgtgggcagaatactggtgaccaaagcattaataacatggtaatacatcagctaccacgtgttgctaaaggatggaatacacacggacttacacagaaacaatgtgacgcatattatatgaatgatggaactgattgtcccggtaaagataaagaaatcaaccgcggtgacggttcggaacgcatgtccggctatgtgacgaaagaagacgtagaagcaggtcgttacaaacctttgtcagaaggcgtctctttacagtatgctaatcgtgagccccgtttctatgcttcagtagcctacaatggtgatgtttggaatttgttgaacagcaataaaaatgcaggagaacctcaaaacatacaagtcttctattaccgtggagacggtaatgggtatacaaactcgatgttttggttacgcaccggcattggagttaaaaaatttgtacacccggatgatatgggtaaaggagacaacaatgaagaacttattaaaaagaaagtagaaccggctatccgttatgcagaagttctgttgatttatgccgaagcattgaacgaattaaacgggcaatacgacataccttcttgggatggtaataagactcatataatcaaacgcgatatcaatgaaatgaaaaaaggaattcgtcctatacgtattcgtgcaggagttcctgattatacccaagaagaatatgatgaccctatcgaattccgcaaaaagttaaaacgtgaacgtcagattgaattgatgggagaaggacatcgctattttgatttacgtcgttggctagatgctccggtagaagaatcaactccaatttatgggtgtaacactttagcaactaaagaaatggcagatgtattccatacaccggtagcagtaccttcattaccaacaaccttctcacgcaaaatgtggttttggccaatcaatcatactgaattaaagcgcaacaaacgtttaactcaaaatccaggctggacttatccggaataatcttataaacttgaaaaaaatgaaaaagatatattatttactcttagccatgactgtactgatagtatgtgcgtcatgcaataatgaatgggaatctgaacaatatgtgcaaatggtatctttcaaggcaccagtcaacgcacaaggagtaactcctatttacatacgttacaagccggaagggaaagtaacataccaactcccattgatagtcagcgggtcaaccatgaattccaaagacttgaatgtgcatgtaggattggatcttgacacattggatgtgttgaatgttgaacatttcggcagccgtaaagaacttttctttaaaccgttggaaaacaagtattacgagttcccggaaacagtacagataccggcaggcgaatgtacaagcttactgcctatcgattttgccctgaaagatttagatcaggtagacaaatgggtattgccgttagctattcagagcaacgatccatcacacaactaccaggccaatccccgcaaattttataggagggcgatgttacgtatttccccattcaatgattattccgggcaatatagtgctactgcgtataaagtatattttaaaggaaacgaaaaagaggctatagttccggaataccatacttcttatgtaatagatgacaaaactatatttttctatgcgggccttatagacattgaccgcttggatcggaaatattacaaaattaaatttgaatttacagaagagaaaatagatcttcaaacacgtaagctgaagatttcttctgataatgaggacataaatctggtagtgaaagggcaaccttcctatacggttgaagaagagatggatgctacacgaccttacctaaaacatatttacgtaacaatcaacaatctggaatatgagtttacagattatacttcagttccgggttatccgcttgaatatgttgtaaagggatctctaacgatggaacgtaaaataaatactcaaataccagacgaagatcaggcaattgaatggtaaatgccaattttaataaaaagaagagtgaattttatagaaagtttactcttctttctatatttgcatacagaataaaatactgagaatcaaataacttcaaaatgaaacatacgcaaattagcagaagagagtttctgaagaatatcggaatgaccggagctggagttcttcttgcagcaagtccctggctttctgccttttcagaagccgtgaacacctccaatgaaaaatgtcgtttgggggttattggaccaggctcacgaggtcgcttccttatgagctttttagtccaaaatcctaaagttgatatcgtagcactttgcgatatttaccagccttcgatagatgaagcattgaagcttgctcccaaagcaaaagtatatggtgactatcgtgagctattggaaaacaacaacatagatgctatacttgtagcgactcctctcagttcgcactgtaaaattgtaatggatgcttttgatgccggtaaacatgtattctgtgaaaaaacaattggttttacaatggaagaatgtttccgtatgtacaataaacatcgtagtacgggaaaaatattcttcacaggtcaacagcgtctgttcgatcctcgttatatcaaagctatggaaatgattcatgccggcacatttggagaaataaatgcgatccgcacattctggtacagaaatggagactggagacgcccagttccttctgctaatttagaacgacaaattaactggcgactctataaagagtattcaaaaggactaatgacggaactggcctgccatcaattacaaataggaagttgggcattgaataaactcccagagaaagtgatgggacatggagctattacatactggaaagacggtcgggaagtatacgacaatgtaagttgcctatatgtattcgatgatggcgtaaaaatgacattcgattctgttatttccaatcaattttatggtttggaagagcaaatcatgggaaatctcggaactgttgaaccagaaaaaggtaaatattactttgaaagtatcccgccggcacccggttttctgcaaatgataaacgattgggaaaataaattatttgacactctgcctttcgcaggtaccagttgggctccggaaacggctaacgaaaacaaaggagaattaatcctcggagaacgtcctaagagcgatggcacttctttgttattggaagcttttgtagaagctgttattactcgcaaacaacccgcaagaatcgcggaagaaggatattatgcgagtatgctctgcctattgggtcaccaagcgttacaggaagaaaaaacactatatttccctgatgaatacaaaattaattatctgaatcatcaatcaaaaacatccgaagcagtatgaaagatacaatcctgaccgctcgacgaaagaaaacagagttgattacactgttcctgtgttttattattgccaatttggtcaatttatactctatatttacgtataatactcctttgacggagatgataacttcatttttttatgtgctcatattttctgtagcgctatatatcatctggagccttttacgtatcctcttttatggcataacagcactattcaaaaagaaaaaagaataataacagatttataacatataatcaacagaatacttaatcaatatcaatgaagaaattatggtaacacgaagagatttcctgaaaacaatgacaatggcttctgccggactggcagcaggagctggtgaaatattgaatgcacaaacattgtcatcttcaaaaaacaaaaacgaaaaagtgaagatagcttatgtaggtatcggtaaccgcgggcagcaaattattgaagattttgcccggaccggcatggtagaagtagttgccctctgtgatgtagacatgggtgccaaacatacacaaaaggtaataggcatgtatcccaaagcaaaacagttcagagacttccgccagatgtttgataaagcgggaaaagaatttgatgccgttgcaattgctacaccagatcactctcattttccgattagcatgctagctttggcatctggcaaacacgtatatgtagaaaagccgttagcacgtactttctatgaagcggaacttttgatgcaagcagcgctcaaacgtcctaatctggctacacaagtaggaaaccaaggacattctgaagcaaactacttccagttcaaagcttggatggatgccggaattattaaagacgtgaccgccgtcactgcacacatgaataacgtacggcgttggcataaatgggatacaaacatttataaactcccctcaggacagcaacttccgaaagacatggattgggatacatggctcggcgctgttccatatcatgaatacaatgaaaaatatcatcagggagaatggcgctgttggtatgacttcggaatgggagctttaggagactggggagcacatattctggataccgttcatgagtttttggaattaggattgccctatgaagtaactttattgcatgaaaaagggcataatgattatttctttccttattcttccactattcttttccgcttcccacaacgcaaagggatgccacccgtagatatcacctggtatgacggactagacaacctccctcctattcctgccggttacggagtatcaggattagaccctaatatccccacgactaaccaaggagatgttccggccgccaaattgaatcctggaaagatcatttatacaaaagacctgacatttaaaggaggaagtcatggaagtaccttatccatcattcccgaagaaaaagccaaagagatggcagacaagctaccccaaataccaaagagcccgtccaatcatttcgagaattttttattggcatgtaacggtatagaaaaaacacgttctccattcgaaatcaatggagtgctaagtcaggtattctcacttggtgtaatggctcaacgcctcaacactcagctgttcttcgacagccgtaccaaacaaattacaaataacgagtttgccaatgcaatgctgacagggatacctccacgcaaaggttgggacgaattttataaattataaatgaacataaccacccattaaaccagctataaacaaattactaagaataacattaaaaatgaaaaagaacttcttatttactttacttttattctgtgcggcttcattatctgcgcagacctgggaacctcttttcaacggcaaaaacctgaaaggatggaaaaaactaaatggcaaagccgagtataaaatcgtagatggtgccattgtgggtatttctaaaatgggaactccaaatacttttctggcaacaaccaagaactatggagacttcatacttgaatttgatttcaaaattgatgacggattaaattcaggagtacaacttcgtagtgaaagcaagaaagattatcagaatggtcgtgtgcacggttatcagtttgaaattgacccgtctaagcgagcttggtcaggaggtatctatgatgaagcacgcagaaactggttgtatccactgactttgaatccggctgcaaaaaccgcttttaaaaacaatgcatggaataaagccaggattgaagctatcggaaattctatccgtacctggattaatggagtaccttgtgccaatatctgggatgatatgacacctagcggatttattgcattgcaagtacacgcaataggtaatgcttccgaagaaggtaaaactgtcagctggaaagacatccgtatttgtacaacggatgtagaacgttaccagacacctgaaacggaagaagcgcccgaacgaaatatgattgccaacaccatatctccacgtgaagccaaagagggttgggccctactttgggatggtaaaaccaacaatggttggagaggagcaaaattgaatgcttttccggaaaaaggatggaagatggaagatggaattctgaaagtgatgaagagcggaggagcagaatcagctaatggtggagatatcgtaactacccgcaaatataaaaacttcattctcacggtagatttcaagattaccgaaggcgcaaatagcggggttaaatactttgtcaacccagatttgaacaaaggagaaggctctgctattggctgtgagtttcaaattcttgatgatgacaaacatccagatgctaaacttggagtaaaaggcaacagaaagttgggttcattatatgatcttattccggctccagagaagaagcctttcaacaaaaaagattttaataccgccaccattattgtgcaagataaccacgtagaacactggctgaatggggtaaaactgatcgaatatactcgcaatactgacatgtggaatgctttggttgcctacagtaaatataaaaactggcctaattttggtaattccgcagaaggcaatattcttcttcaagatcatggagacgaagtctggtttaaaaatgtaaaaatcaaagagctgaaataacttgcactgaaaagccgatttctaacataaaatcaagagtagaagggcatgcacaaagtggcatgccctcttaatatttcaataaaacaaaatgcagcatacaattcaacacttatacaagacacatggtgatgacggtttgctttatgcttggtttttatccatgcatacacgcgtagatataatactctgctgccagaaatcagaaaatgaattaatgcttgtagttaatagtatatatgacactctccgacaactggaaagaattgcaaattattatgacccttccagtgaattatcgcaagtcaatcaaagagcttccacagctcctgttatgatcagtcagtctctttacaggatgatttcattgtgcacagaatatcataaaaaaaccttaggatgtttcgatgttactatccactcagataattataatcaagataccatacactccattcatttataccccgaagcacagagtgtcttctttcaacaagcaggtactacaataaacctttccggatttcttaaaggttatgctctcgacaaaataagagaaatattaaaggttcacatcatagcaaatgccttaataaatatgggaaacagttctgtactcgctctaggcaatcatccggttggcacaggatggaaagtcagctttgacgatcaggcaagtactacaaaaaaccataaaactcaatccatactccttaataacgaatgtttaaccacctccggaaacaactcggatgatcgcaaacacattatctctccttcaagtggcaaaccactggaaggagtaagacaagtgacagtagtaacggatgatggaaccaccggtgagattctctcaaccagcctgttcgtagcaaatcaaaaacagcgcgagttaataatgagcgagtttctccccaaaagagttattgatttggaactgtgccagatggtttaggtaacggagtattcaccggtaaagggactcccaaatccggcattccatcagcatcccatcctatcttctgcaatcgtggattgcgactttccgactctcccgtattaccgctaggaacacttcttgcctgatacaatatataccattccgttccatcaggcgaaggaagaaaggaaaggttagccgggccatacactccatcttccggtctctgttgaaatacaggaacggggctcttcttccaggaagccggattcagcaagtcactatccgcgtcagcagtcaacattccggtacaataataaggagaccagcaaccgcttgccgcataatagacaatgacagtccggttatctttggaatgaaaatactgagggctttcatttacataaatcggataagcagtccgcccgccatccggatttacccactgccgttcccattcatactccggcttcgaaatcagaaccctttccgtagccaatgtccaggggttttccatgcgggcaatatagatgcattgtgtttcactgcctatcctccgattaggccacccggaccatagaagataaagctcccctttatgttcaaaagttgagggatgtattccccagttccaatcgggattggtcatgatcgctcctttcatgcgaaactctccctgcatagggtcaggagaatcattctcaatcacataaatctgatgattatctgtatttccatcatcggcagcaaaatagatataccatttaccattgatattccgtatttccggattccagaggttatggctattcgaaggatctttaggcacccagacctctttacaagtggaatgagccatatcggtaatatcggtggttacccacagatatatttgctcattagtttcatgggtataataatatttaccattatggtaaatcgcgcttgaattagccccttccataaataatggattggcataagtatctttttcaacatcttctttttttcccgcccgtttggaattacaagagatgttcagcaaaacaaggaataataacaaacataaattgattctcatagtttcatttttaagatgatacaaagaaaagacttttttttcattaatagttgatatataaaaaataaatataactcttttgatgtcgataattttaaataatatatcgatattgttttataataaatcctgctatagtcgttcatgtcgatattgtattactctaaatcgtattagtcctacaatgtggactgccgagttgttacatttgcggtatataatctaataggaatatttatgaaaagtatgagaaaaaacacatggcttcctcttattggactccgaacttttctttttgtgaccacagcgtttacaattgtttcatgcagcgatgacaaaggagaagacgggtataaccctaatcttccggtcagaattagcgaattgtctccccaggaaggcggatactttgataaagtaatcctccagggtgaaaactttggcaacaaccctaaaaaggtacgtgtattctttaataaaaaagaagcgattgttgtaggagcatccggcgatcgggtgctggttcatgtcccgaaactcccgggcgatgattgtaagataggtatgcttttaaacggtaacaccaccgatactattttcgcagaaaagcatttcgcctatgaaaagaattatcagttgatatatgtagccggacagctcaactccaatacagaaacatttgtagaaggaagcttggaaaccacaacatttgccaatagtatgcagcatctagcgtgcgatcccagtggcgtcatatatatgaaccataaaaatacaggtcaaagtggcagtcttatttacattaatgaacctgagaactactctaagtttttggattatggagcatctactgaaaacggaggctcgcctagcactccgtattatgatgacaaaacagagaaggtttacttctgtgcgcaccatgctccatttttttgggaagttgatcctaaggattcatggtcttttgtgaaaaggaagttgattgcccccgacgccagttaccaggcaaaaggatatcgtcccgtaccaagcggtcagaagttggagtatatgtgttcctatgctcgtgcaacagatgctaatggcgaaagttttatctattgccggacgtggcaaggtcaattcttccgtttcaaacttgaagatcgtgtctacgattatgtcaccacttttgccaaatcagatgcatgtctggctacagaccccgacgacccgaccaagatttactgtgccttgaatgaatacaacaaaataacctgcattgatttgacaaagaatccggaagacagcggctttgagacagatgtctgcggcatacagggaccaggagcatatcaagatggacacgtttctgtggcaagattgaacaatcctcaacagattttgtcaatgcacgaccctgaaaccggagaaaaggtgatatacatctgtgatgccaacaataactgtgtacgtatgtacaatatggagacaaaattgatgagtaccgtagcaggaataggcgggaaatccggatatgctgccggaaatcctacagtttcaagaatgaacagaccttatggtatctgtataactcccgaaaatgacatttacgttgcagatgcaggcaataaagtaataatgaaactggcatttatgtaatgatgagtagtaatcgtttaaagaagaaaaaaatgaaagcttatataacaaatagaatatatcttatgctgtttttctgctccattaccataatggcacaagcacagcaaaagtttgagatatccggtatagtccaagatgaaacaggacagcctgtcccgggagtcagcgtatatgtaaaagataaaacaggcataggtacgaacaccgatatggatggaaaatttgttttgaaagtcgatcgtggagataaagtgcagttcagttttataggatataccagacacgagtatctagcattaaaaactgaaaaaaaactggttatccaattagtaccggatgtaagtgcacttgatgaagtggtagtagaagcttatggaagcaagactcgtaaaataacaacgacaggtgctgtcacttccgtagacgtagcgacattacagactcctgccaccagtctggctaatatgctgggaggacgagttgccggtattatctcgacacaaggcagtggcgaaccgggtaaaaatatctcagatttctggatacgcggtatcggaacatttggagcaaacgcatcagcacttgtcctcattgacggtctggaaggtagcctgaatgatgtagacccggctgatattgaaagtttctccgtattaaaagatgcttcggcaacagccatgtatggagtacggggggcaaatggcgtagtacttgttaccaccaaaagaggaaaacaagaaaagttaagctttactgcacgtgcaaatgctactatttcatggctaaagcgcctaccggaatattgcgacggatataactatgcaaaattggcgaatgaagcactcgttgtacgtggcgatgaccctaaatatacgaatcaggaactggatatcattaaatacggcctggatacggatttatatccggatgtcaattggcaggatgaagttctcaaaaggtcttattggcaacaaacctattatttgagtgcccggggcggtggtagtatagcacgatactttatcagcttaaatggttctaacgagacttctgcttaccaacaggataaatccagtaagtattttaaaggtttggcatataataccttcgggctacgtgctaatattgatatagatttaactaaaactaccaaattatattttggtgtcaatgccaataagacaatcagaaacctgccgggtgccgcagatactaatctgatctggtctgcttgcagcaaactgactccggttaccataccagtggtttactctaacggaatgcttccttcagccaatggagtgacagatgaaatgtccccttatgtacttctgaaccacacaggattgaaacaagaagaagaattcacttctacttatacattaagtttagatcaggacctgggtatgctgattaaaggattgaagctgaatatacaaggagcctataccaacgacaacgcttttcatgaaacacgctacatcatccccgaactgtggtcatatgataagcgtaatgcaactggagaactcgcaggaaaacgccagaccgaacgcataacgacccagtacagtaaatgggaaatgcaataccgcaaatacttccttcaggctaccatgaactgggcacatgatttaggacacggacacacgcttacggcactggcgcattatgaaatgagtgatcaaaagcggtcaactgatgccaatgacacgatgtcggctattccagttcgttatcaaggactttccgctaaagtcggctacaattataatgatacatatatagtcgacggcaacttcggttatacaggttccgagaatttccagccaggacgccagttcggattctttccatccatatctggtgcatgggtaccgagtagttatcaatggacaaaagataaaatgccatggttgaactattttaaaatccgcgcttcatacggtttagttggtaacgaccgtatcaccgacaagcgttttccatatctgaccagcataaatgtaaatggttccgctaccacaaactggaagtataccaagggaggtatttgggaaaactcgatcggggcagataatctggagtgggaaaaagcaaagaagtttgacgtcggtctggaaggtaaattattcgataaatttgagtttgtaatagacttcttccgggatactcgcgacggaattttccaagaacgcaaacaagttcctgattttgtaggactcgtaaatatgccattcggtaatgtgggcagtatggtaagctggggtagcgacggcaatatcaccttcaaccaacgcatcaataaagacatggaattcacgcttcgtgctaatttcacatactctaccaataaggtgaactactatgaggaaggagataccaagtatgaatatacatcagcaacaggacgccctaatggctacatgaaaggttatatcgctttaggacttttcaaggaccaagaagagatcaacaatagcccgaaacaagatttcggaagttacctgccgggagatatcaaatataaggatgtaaacggtgacggtgttgttaacagtgacgaccaggtaccagtcagctatcaggattacccgcgtctgatgtatggtttcggaggagaatttcgatggaaaaagctgacattgggcgtacgtttcagtggaataggtaatacagactattacaaaatatggacatggggaagcaataatgtgggatatattcctttctatgatggtaaactgggcaatgtactcactattgcagccaatcctgccaaccgttggattccggccgattatgacgatcccagcataccagccagtatgagagaaaatcccaatgccatgttcccgcggctaagttacggtagcaatcagaacaatgcgcaggcatctacattctggaaaggcaatcgcaaatatttacggctcgatgaaatcagcctgaactataactgtaactgtaatttattaaaaagtattggaataaattcgatcgatctcgctgtagtagcaaacgatttgcacacttgggacagcgttaaattattcgatccggaactcgccacaagtaatggacgtgcttatccgattccgggccgcgttagtttccaggcaatcgttcatttctaaacatgatcattaaataacaaaattatgaaaaagtatatattacaccgatcaataaacctattcatcgtatttcttgggatacttacgaccggaggattcacctcatgcaattttttaagagtcgacgactattttgacgatacaatgaagtttgacagtatctttactaaatacgagtatctggtacaatatatgtggggaacatcagatcagttccccgacgagagccgcatccttaccgatccggtcactcccggtccgatggctacggatgaagctttctcaagtcagaatccggagcatggccttcgcggactctcctacattctgggaactattaatgccgataacatcggtaactatagcatgaatatatggtcgtccatgtataaagtgatccgtaaatgtaactacatactggcacgcaaaggagaggctcacatgaatacaatacaagatgaggaaatcactggctacacccacatgatgcgtggttatgcttattacaatctgatccagtcttatggtccgtgcattatactcggtgatgatatcttacccaataatgaattacctgaaacttacaattattcccgttcgacttatgacgaatgtgtggattactgttgtaatgaactggaacttgctgccaaatatatgcctatagacttaaatccgactttttttggacgtccttcacgtggtgctgcttttgcgttgatagctcgtctgcggttgcaacaagcaagtccgttatataatggcggacaggccgcacgcacagctttcggcaactggaagcggacagtggacggagccaactatgtgaatcagaactacgatgaaacacgctgggcagtagcagctgcagcatgtaaacgtgtcattgagatgaacaaatacaaattgcatacttctcccatcgatcccagcatgcctccccgagtattgccggcttccgtgacaatcactgaccccgattttcagaatatcgactattatcgttcctattcagaaatgttcaccggagaaacgataggcagtaaaaatccagaatttatctggggtagacagtcggatgctatggcaaacatgacacaatgcagtttcccgacggaaaaagcaatggggggatggaacaacctctgcgttactcaaaaactggtagacgcttattatatggtggatggacgagataaaaatgatgcaagtaaagaatatccatatcatgtagcaaacggtacagtgaccgatgattacttttccaccagtgcagaggagttctccggctacactattccgatgggagtatacggtatgtatctgaaccgagagaatcgtttttatgctacaataggttactccggacgttactgggcagcacgttccaatacccaagaacaatatggcccttatagggcgtggtatcatcaaatggtaacttcaggacgcgatctgttttccgggaaaaattccgccataaccaatcctctggattatccggcaacaggatatgtgctgactaaatggatccatgcggacgacgcatggataggaaccggaagtatgcgaactaccaaatattttcctatcatccgatatgcggaaattttattaggatatgtagaagcaataaatcacctgagtaaaagctataccgtcgaattacccgcaatcaatggtggaaataatgctccgcaaagctatacagtcgaacgtattccaactgaaatacaaaaatacttcaacccgatacgaaatcgcgtcggtctgcctggattatctgacacagaagccgcatcagatgaaacaactttggacaacatcatcaagagagaatatatgatcgaattcgcttgcgaaaaccgcagatactttgatgtacgtcggtggggcatatatgaagagactgaaaaaactggtgtttatggaatgcgtttgggaggagataaatatacttattatcagaatccgattcctgtgaatcaggttaacaaccgaaatcgcgtgatagataaaagactgattctattacccttgcccaaagctgaagtacgtcgtgtagaaaatctcgaccaaaacccgggctgggagaattaataatttacttcgtattaaaacataaataaccatgaaaacaaaatatatttatatagcttttttaacaatcttatgtgggggaagcttggtggcatgctccaatggcgacgagttcttcaaggatgaacgctacaagaagatgatctatgcaatcagcgacaatgagcaaatatttcacgctgaatttgaactgaataatgaagaagatatcataggcgtgcagcctttcgcagtaagcggcactaatcctatagatcaggatgtgcatctgaccatagaaaaagatccggagctgttgacggaatataactataatacctacatggatgaaacagataaatatgcccgtgagctgaaggacggggattattcacttttatcttctatcgttgaaataaaagcaggagtgaaccccagctatgaagtgggaaaattacaagtgaaaataaagacatcgatcattgaaaaactatccgttgactctgcttactttctttcgttccgcattaaagaggcaacaccttacgaaatcaatgaagaaaaaaggaatgtattattccgaatttataaaaagaatcagtatgcatcccaaaagacacccacttactatgcctcttccggctttatggatgatgtcgtaatgccgttcgactctaaaattatcatgccattggcatataataagatacgcacttacattgccggacaaatttacgatgcgaatgataccaaagaaacaatcaacaaaaattcgatggtaatcactgtagatgccgataaccaagtactgatatctgctttcgattctgagaatggattaaaagttgaaatgttatctccaagttctgatcccaatgatggctcatatggatatcggaactattataatccagaagaaaagcaattctacttatattatcgttttgataatggtgaaggctggaaggttgtgcgtgaaactttaagagccgaatctatcataagtaaatagtgattggcgactatagatattttttcattatgcgaaaagaaacagacgaatattgctgtgttttaataaaaatacactatattgcggtattgtttaaccttaaaatatgatagccatgaacacaaaattattcggtttgtttattgcattgttggtatgcctgccttcgcttgcccaacaaaagcctgtggagaaggtagatagtgatggagtttatctgatgcccgatcaaatgccggagtttccgggcgggatgcaggcgatgatgaagtttttgactacaaatatcaagtatcctgtagaagcacagaagaaaggcgtttctggtcgtgtgatcgtacagttcgtcattatggaagacggaacattggatcaggctaaagttgtaagaggagtcgatcccttgctggacgaagaagccttgcgtgtagtgaagttaatgcctaaatggaaaccgggaatggatagaggcgaggcagtgaaagtacgttttactgctccgataatgtttaatctgtccagatcggaggcacagagacctacttttcccgaacttgtagtacctatcggacaagaagtggaaaacaggtctttgcaaggagtatggcagagttgcgttgtgcaaccgggcgaacatggatataaaattctgttattgcctgttttaaagatcgtatcgcctgatcagacattcatgaatataatgacagccggtatgaacggcaggtcaaatgccatcatctattgtcagggagagtacagtttgccgtcggatggcacttacgtggagatggtggaaaaatcggttgatccggttttcatacaaggagtaaagaatgaaatcagtgtggaacgattgcatgataatctgattaaattgtcttttacggttccgggacagggaagaaaagtgacggaatattggttccgggccccttcgccggatgtgaagataatggctgattgatataataatattattttaggcacggatttcacagattacacggtcttaatgaataaaagccgtgttcatctgtgaaatccgtgcctaaaaagttctctgtactttcttatcttcgactcagcttattattaattcttaaagaatccgttatcttcccattttcccgcttcctgtggctgtgctgatgtggcgcttacatcgataggcagccatacttccatgtcaccctcgccccgatgtgcccaggcataatagggtatcagtgtgagttctacgtctttagttaccagttttccagctttgtcataacttaatgcctgcgcatcggtcgttatctgacggatgccgtaaagtaactccggtttgtctgttaccttgaattgcggatgctggttgagaagtatgctgtggacgttgaatctgttgtccggccattctgcgcaataaacgatggggccgcgttcaacggcaacacgtccgtgatcggcttctacttttggatttgcctttactattcgggggatcatgtcgaaatgtacctctaccacatctccctttttccatttgcgggcaatgctgagatagccatcattgacatcgctttctactgtctgtccgtttacggatacttggtaggcaggtttctgattgtcggcgtaagaatacagatcaccgggaagtacattgccgcgtacccagccggggatacggagtttcatggtgaagtcctgattgccctgcgttattttcaggcggatgtcgccattccagggatagccggtttcttgttccagcagaatctttttcttgtctacctttagctcggctttgttggaaagataaaggttcacgtatacctgatcgttcttcacggcatacacatatcccggtaatgacggaatgaaacggctgacgtttgaagggcagcaggcgcagccgaaccaaggtttgcggctgtattttccgttagaagacagcgggttggggtagaagaaagaacctccgtccagtgatacacccgatatcagaccgttgtatagtgtgcgttccaggacatcgaaatatttggcgtctccgtgcagcaggaaaagacggtagttcatgtatacattgccgatagcggcgcaggtttcacaataagcggacaggttaggcagctcgtagttgttgccgaatgcttcgcctgcatggtgtgcaccgatgcctccggttatataaatctttttagaaacgatgttgtcccaaatcttgtctatcgctttgatgtagctgctgtctccggtgatggctgccacatctgccatgccggaatacatatatacggcacgtacggcatgtcctacggcttcatcctgttctaccacaggtttgtgtgcctgactataggtgtctttccggctggtatatccacgggtatccaggaagaattttgcctgatcaagatactttttgtctcccgtcgccatgtatagtttgactaaagccatttcggctatctgatgccccggtacgtatttcttctgttgagggccgttgccgatttcgcggcagacacagtcggcatatttaatggcgatatcgaggaagtttcgttttccggtagcctgataatgcgctacggctccttctatcatgtggcccagattgtagaactcatgactcaggttctctaccgctacccaacgctcttttcctgcccagttgtgcgggtgcttcgggttcatggtgcgggctgtataaaggtaaccgtccggttcctgtgctccggcaacaatgacgagtacgctgtcaatgtacttttgcagtttcttgtccggataggtttgcagagagtaactggctccttctattgttttgtatacatcggtatcgtcgaaagagaagccctctactttgtaggtatcgctgggatgtgctgcctttacaaagttttcgtaacgtcccgtctcttcacatttgctgaatgccagagggatggttacttcacggcttgcttgaaggcgctgtccccaaaagttgtccgtcactttaacggaagtaaaggggacagggtctataggatatccatgatttatttgcgcgctgcctgttatgcagatgcaggtcaggaatgtcgcagtcagaatgtttttcatcttagtatttattttagtatgaatctctgttgcggtgttatggtgtagggattacctgtttgattgttccgtccggattgaattccatccggtcaatacatacttcgcggtgccagcccggtccgtcattcagatggttcttgttgatacggtggtatacgatataccatttgtcttttcccggtacttgcaggatagagttgtgggcaggtccgtagatctcttcttttggattttggatgagtactattggttctttggctacttcgatcggacctagcggtgattgggcggtaccataaactacgtggtagttgggtgagccggtgtcgtctacagaccagaagaagtagtaaattccttttctataaataacgtaaggagcttcacggtatgcgtaagtctgcaaagtccctcctttgggagttaatactaccgttgtctcttctttgatggacagcatgtcgtcgttgagctcggctcctgccatgtagccgttaccccaatagaggtagcttttgccggatacggggtcggtgaatacatccacatcaatctgctgtccccgtcctgtgggagaagaggtgatgataggtttgcccagatctgtgaaaggtccggtgggggagtcggctacggcaactcctatttgcttgcctttgttggtcgttgggttggcactataataaaagaagtatttatacttcccgtctatcttcttttcttcgatgcagggagcccatgcgtttccgtttgcccaagacacatttttgcccatctccagaatcacagtctcttctttccatgtttttaaattcttcgatgaaaagaccttaaaataacttccgccccatcccggaaatccgtcactggtggggtaaatataatagcgttttgtctgatgagaatacagtacttccgggtcggcatggaaccccggtagaataggattgccggatttcttattctgtgccgttacttgtactgttccgatgagtaataagtggaatagaaagattctggtaaataaatgcttcatgatatttatagttagatttttattatattataagtacgacaaagataggggatccacctaaataaaaaggttacatatctgtcaaaggagggtaattatcattcataatagggaagatgatctaaatttggactttaatgaacggtattcggatgtccttttgtatctaaagcattatttttgcgctgaatctaaaaaatagttggttaccatgagagcgaagctgattttaccttttctgattttatatttgttctgtcatttgctgtcggtgcaaggacacgaagttgacattgtaaatgccggcagtgataaaaatgtagcatcttctcaagtgtatgaagtaacttccgaaggagcatggtgttggttcgctgatccgcgtgcgttgcattatgagaatgaaaaaggtacaataaacaagacatatgtcggctatattgatatacacggcaatattaaagcgatgcagtatgactttaaaaagaaaagacaggacgaggtactgattcgttcctattttcagccggatgatcacaataatccgacgtttctggtattgccggatgaacggattatgatcttttattcccgtcacacggatgagccttgtttctactatcgtatttcccgccttcccggagatattacgacattgggagaggaaaaggtgattaaaacaaaggacaataccacctatccgtctccgtttatcttatcggatgatccggaacatatctatctctgttggcgggggattggctggcaccctactatcgccaagctgtcgttgcccgatcagaatgatcaggtggcggtggaatggggaccgtatcagatagtacagtctaccggtgcccgtccttatgccaagtatatgtcgaatgggaaagataagatttattttgcttatacaaccggtcatccggataatgagaatcctaatttcctctactttaattatatagacattcactctttgcagttgaaggatgttaaggggaatactctttcgactattgctgacggtacttttaaagtgaataagacggatgattatgcgcgtcagtatccatctactctgatagataatccatccgcacgcgattgggtgtggcaggttgcttcggatgagaatgataatccggtcattgcaatggtacgaatcagtagtgataagaattcccatgattactattatgcgaagtggaacggacacgaatggaaaaagacattccttgccaacgccggcggtcattttcaccagacaccaaactcggagaaatgttacagtgccggtatgactatagatccggcgaatacgaatcatgtttattgctcgttgcctgtggaaggaaagcaggggaaggtttacgagatcgtgaaatttatcttgaacgaggtcggggaggtggtctctacagaagcggttacgcaagactcgcagcagaataatgtccgtccttatatagtaccaaattcaaaaaatacgcctttgcggctcacatggatgtatggcaattattacgattggattgtcagttcacggtatccgcaaggctattgcacagggattgcctgtgattttaaaggtttcccgggggcgaagaaggaaaagactgttgtaacggagaaggatttcaagttcaacccgaagaaggcttttgtattggaacaaacggtcactttggatgcagacaattatcaaggctcccttttacaattgggtgatcttcaatattatctgaacggacaaaccatgaaaccggaagttagatataacggaaaggtatatcctagcacaaatatacttggaacatctgattgctggaaaacaacttcgcgcaatacaggcggtgagtggtacactccacaaaagtacgggagtttcaagttgaagctggagtataagaagggagtattatgtgtgtatattaacggattgctggatcaaaaaatagaaatacaatgagaagaaaagttttaagagattgtgtgataggagttcttttattatttgttctcccgttggcagaactgtcgggcgctattgctcaggagagtgtgtttactgtacagcagcctgattttcaaaagagtccttatacgggaatgacacgtcaacactggatacaggcgggagagtatctgctgaaaggagcattcggttatatccatacgttggatgatcagatgtactttccgaagcaactggacaaaacatatcccaataatgacggacaagttccggttgctaagttggaggggctggcacgaaccttatttattgcagcacccctgttgaaagataatccggaactggtaatgaatggaataagagtagcagattactatcggcaccaattagtcggtatctctaatccgaaaagtccgagttttatttctcatcgtaaaggaggacctagccagacgttactggagttaggttctttggccatttcaatgaaagcggctcaggccgttttgtgggacccgctgacaaaagcgcaaaaggattcgcttgctgcaaccatgctgagctacggagaaggaccgaccataggctctaactggatgttctttaatgtctttattttaagttttctgaaagatcagggctatgcagtgaatgagagctatctggagtcgaatttaaagaaactgctggcacgttatcggggggaaggctggtataatgatgctccggcttatgattattacagtgcgtgggcttatcagacatacggccccatttgggcggaaatgtttggaaagaagcaatttccccagttggcacagcagttcctggcaaaccagcatgatatggtagctaactatccatacatgtttagccgggatggtaagatgaatatgtggggacgaagcatctgctatcgttttgcagcgactgccccgttgtctctgtgggaatatgataaaagtggcgatgtaaattatggctggataaggaggattgcttcttctaccttgctgcaatttctggaaaatccgaaattcctggaggaaggagttccaacgatgggattttatggcccgtttgctcccgctgtgcagatttatagttgtcggggtagtgtatactggtgcggaaaagcttttttgagtttgctgttgccggaaaattcagacttctggtctgccaccgaaaataatggtccttgggataaagaactgaaaaaagggaatgtctataataagtttcagccgggaaccaacctgttgattacgaattacccgaatagcggaggcgctgagatgcgctcatggtgccatgaaactgttgcaaaggactggcagaagtttcgtagtacggagaattataacaaattggcttacaatacggaattcccgtggatggcggatggtaagaacggagaaatatccatgaattacggaacaaagaatcagaaaggcgagtgggaagtattacggctttatacgttccaaagttttaaagacggtatctatcgccgtgatgccgtacttgaaacagacagtacagtaagatatcaactggccgatattccgctgccgaatggaatattgagagtggataaagtttcggtctccgaaccgacggaaatctgtttgggacattattccctgcctcgtttgaatggtgtatttaaagaaacatcccggagggtcggcaagctggatattccggttattgataacggagagtatgaactggctatgataccattggctggatgggataaactatatacatcgtatccgaaagggctgcaccctgtcagcgatgagtgtgctttgattatggcttctgataaattggctggcagcaagatttatgtgacgcttcaactttggaagaagaatgaaggtaagaacggctttacaaagaaagagttgaatccggtccgggcgatagatatttcggaagataagaaacaagtgacagtgcgtctggatacgaaagagataaaaacggttctatttgagtaatttagaaatatgagaagtgtgcagtgggaatattttcccactgtattttttatgtataatggtgagccttaaatgcctatatggtgaattttccttcaaaacgttctacttatcagtatatctgtatagctggaactgtctaatcgttgtttattaaattttttattcataattttggtcgtatgtatagttgtcaattattatattgtatttaacgaacaaaatatgaccatatgaaaaacgcgcgaatcgttatcctttattataagctgagttttttgattctgtttttgcttttgaagtctgctttactattggcaacagaggatgtcatctacaacctcaaatttaagcaactttctgcaccatattccttgccgacaaatgaagtacaaaaagtgtatcaagataaagatggatttatctggttcgctactcgtaatggactttgccagtataatggctatgagaccactctttacaaatccaatctttactctccggatttattgactaccaatagcatcacttgtttggttgatgataataataatcatctttggattggtacatcggaaggactgaacgtgatggataaaagaaccggagaaataaaaaagtataaggcaccatatctttctaacaatgtagtgtctgctctgtgtgtgactcgcgataatactgtttgggtggggacggataacggtttatgtcgttatgttgcagagaaagatacttttgtagtttgtggagatgactttggagatagtagactgcggtatgttaccataaaatcattattagaagattcagatggcgatctctggattggaacttgggcacaaggcttatttcgttattctccatccacagataaagtggaaatatatccgaaaatcaatgaccaatattcttctcatgtaatttatgaagatagtaataaagatatttgggtagggagttggggatatggtctttttaaattgcagaatcctaaagatatgcaacgtgtgtcttatcagcgttttctgcatgagaacggtgatgattccagtttgtctgataatatagtatatgatatagcagaagatatcaatactcataccctgtgggttggtacacgtagtgggttgagtatcttaaaacttgatgaaccggacgcatttattaattataaatcgggaaaaacagattatcgtattccttctgacgaggttaactcgattatgcgtgatgctcagaggaatatgtggataggggctattgggggaggagttctgatggctgatacacgtcaatctacatttgctttatatacacttaactttggagatgaagatattccggtaacttccgttcgtaccttatttgctgattcagatcaaaacctatggattggagtaggaacttatggactggcctgtagagagtatgaaacaggaaagctaaagatgtattcgcacataccggaattttcggggttaaaagatttgccatcccttttcgcagttacccagcgtaagaagagtggtgaaatctggtttggtatgtataatggaggaatctacgtatatcggaaaggtgaaaaggtaaaacacttgactacaaagaatagcggtttccttacttctgattgtgtgtcggctttatatgaagattatgaagggaattgctgggttggcacgcgaggaggaataggggtcagattggctgacggtacagactatcgctttgaaacgatgaactttaatgatagtttgtcggcaggctggatatatgtaagagatatcataaaggatatggatagcagtgtctggctggcaacttctaatttgggtgtgattcatataacgggggatgtccgtcaaccttccacattgaaatatgagaattatagttttcataatcgtaagctaatcacaaatgcagttctctgtatacatcttgatcgttttggtcgattgtgggcagggactgagggaggaggattatacctttataatcgtaacaaaggagaatttgaggaaaaaacgcgtgcatatagtattccgggagacgttatcgttagcatagaagaagataaaagtggtaatttatggctgggaacgatttccggactagtgaaactttatgtagctgctgttggaaatgatttctcgacccgtatctatacttctgctgatgggttgcaggataattttatagtcaattcatcgtgtagtcgaaatggagaattgttttttggaggacataagggttacaacagtttttttcctgataaaatggaaataccctctcaggaaaccaatttcctgataacagatattaaaatattcaatcattctttcagtaacttgccggttgaactgcagcagaagatttcgccggtaatgcctacctataccagtaagattgaacttcctcataaatacaataattttagtattgaatttgccgcccttacctataagaatcccgaactaaacagatatgcttaccggctacagaactttgacagggattggcagtatacggatgcagaccgccgctttgcttattataacaatctgccgagcgggacatatacttttcagttgaaagcaaccaatgagaacggagaatggagtggctatgtacgtgaattgacagtggtagtccttcctccgttctgggctacctggtgggcatatctgctctatgtgataatagtatcagttataggagtttcgatttaccgtacagcaaagaatcgtatattgcttcggaatgccttgcgtctgcgtgaaatagaaaaagcaaaagcggaagaactgaatcatgcgaaattgcagttctttactaatatcacacatgaactattaactccgttgaccattatttcggctacagttgatgagctgaagacacaggcgcccagccataatgatttgtatactgtaatgaatagcaatatacagcgattaatacgtttactgcaacagattcttgaatttcgaaaagcggaaacaggtaatctgaagttacgggtttcgccgggagatattgctgcctttgtgaagaatgcggctgagagtttccagcctttagtaaagaaacgtaagatacacttttcatttctttgtgatcctgaatcaatgataggctactttgacatggataagttggataagattctgtataatttgttatctaatgcagctaaatacaataaagaggatggatttattcaagtctccttatcttatgatgagacagataaggattttatcctgttgaagattaaagataacgggaaaggcatttcaaaagagaaacagaaaaatctttttaaacgattttatgaaggtgactatcgtaagttcaatactattggcacaggaattggactttcgctgactaaagatttggtagagttacatggaggaaccatctcggtcgaaagcgaagtggatcatggtaccgaatttatggtacggattcctattgagcgttcttattatgatgaagagcaaattgatgatgaggctatctctttaatgcaaaatcctgtaaattacgaggatacacaggaggatgccgatgtagaaactcaggaagtgactataaaggctaacactatattattagtggaagataatggggaattactacacctgatgacaaagttattgagtcgtgaatacaatgtctttacggcccagaatgggaaagaaggcattgcagtattagaaaaagaggatgttgatttgattgtgtctgacgtaatgatgcctgagatggatggtattgagttctgcaagtatgtgaaagggcatctggagatgagtcatataccgatgattctgctgactgccaaaaataaggaagaggacagagcagaagcttatgaaattggtgcagatgcgttcattagcaagccctttaatctgacagttcttcatgcacgtattcgtaatctgctgaaatataaggaacgaatggcgcgtgactttaaaaatcaaatagtttttgaggtgaaagacctgaattacacaagtttggatgaagactttattcaacgtgctatccattgtgtaaataatcacttggaagaccctaattttgaccaggcgcaatttgcagatgaaatgcgtacaagtaaatctacgttatataagaaattgaaatctttggcaggtttgaatacttcttcttttattcgaaatgtccgtttgaaagcagcttgtaggataatggaggaaaaaggcactaatgttcgtgtttctgaacttgcttatgcagttggtttcaatgatcctaaatactttagttcttgtttcaaaaaagaatttgatatgttaccgtctgaatatattgagcggtttattcaaaatgtataggcatagataggggtaacctatttaccaataattattttgatatgcatatttgtaaaatagtgcattgtagggtgtaacaaaccatattctgaggatagcagagttatagttaagtttagtatggcaataagctaacaaagttctttggaagttcttaatcagagatggatatgctcaataaatgagaagattcatgtgaaataatcaaatcgaaataaaccttttattgtttagtgagtgcaaataacggcatttcgcgggaataatgcactatgttctctcctttttcttttgcaaaatacccttttttatgaaataagaccaaaacttaacgtatgggtgttccagtgagagtctgtaataaagtcagaagccatattgaatgctttgcgcaaactctatcccggtgataccgggcacctgaatatcaaggatatgatcagaaatacccctatgacttttaatgctgaatataatgttcgtttcactgacatggcgataaagttactactttttcagaacttatacttcattcccatcgaaacatatacagccggtttgaaataagggtccgtatctctggacatatcttcgaaaaaggccttcagtgtacgtgttgtgtaataagcaatccggctgcacgataatcctcccatctctgctatcagacttagcttcagatatttattcagattcattcctgccgatagttccatcatagaaactttgatctgatagcgtccctcagtgctccatcgctccgtataccaaacgtatattttcggactttattctttgctccttacttttttattttaactttgtacgtagataaaatacctaattatggaaataaaaaaattcatcgaaaactatcgggaagcttttggcgaatatgctgaattgcctatcgtattctggtactcggacattcttgaaaatgaaaccgggaaagtgaacggatgcttctttaaaagcatgagtaaagtcaggggaggtaataccatcagtctgaatgcggaaacaattggttgcggcggtggtaagttttataccggattcaccgatatgcccgagcacgtgccgacgttcgtatctctaaaggaacgatataagcagacgccggaaatggtaaaaagctttattgagcaactaggagtaccaagggcagaaaaggaatatctgcattttgcccgtatagataaagtggaaacgttcgatcatttggaaggaatcctttttttggccaatcccgatatattatccggactgaccacctgggctttcttcgataataataaggaggatacagtgatttccactttcgggtcgggatgcagttctgtggtcacacagacgattctggagaatcgtaaaggcggatacagaacattcatcggcttctttgatccatctgtacgcccttattttgaggctgatatactgagttataccattccgatgtcgagatttaaggtgatgtatgagactatgcgcagcagttgcctgtttgacacacacgcatggggaaagattcgggaaagaaaccataatagctacaaagaataagaatatggattttatacttcgtccatggaaagtatctgatgccaaagccttagcaaggcatctgaataataagaagatatgggataactgtcgtgacgggctgccttttccatatacagaaacagatgctgatgccttcattaaatacgcttcggaacaagtggaacagaatgaatattgcatcgaggcgaatcatgaggcaatcggtaatatcggattcgtccgcgggacggatgtcgaacgcttcaatgcagaagtcggttactggatttcggaaacatactggaacaagggccttgcaacagctgctttagaaagagctatagaacattattttcagcatacagatgtaatacgcctatatgctacggtatatgaacacaatgccgcatccatgcgtgtgctagagaaagcaggatttcagaaagcaggaatacatcgtaaggcttgcttcaaaaatggccagttcattgatgcacattattatgaattacttaaaaataagtcgtaagcctccttgctttgttaccgtatatattactgccgactatctttatacagaacctaatacatcgaacgagaggtcccaattcatcacgaaccggaacctctctatgagttattactttcgaagttttactttatctctttaacttcttctcctttttcattcagaagtacggttacttcctgggcgtcttttgtagtgataattactttataaaccttaccggtttctttttcggcaacatacgcttccttgatggtagcatcttcatagcttttcgttattgcctgtgtcactgcttccggcaaatctttcacttcaatctttgtatactcatcctgtggagcttgtgtctgagtttccactgccggagtgttacttacttcctgtgcgaatgctacagaactacctaatcccaataccaatgctactgctactaatacctttttcataatcgtaattttttaagtgtgaataatagaactattgtttcttgtacttaatatatagcaaagcagatgccaaacgtttcactccgccatatataactgataatcaaacatataaacagcagacaatataaatataattgtggaattagtgtggaattatgtagaatctgttgatacataattggggaattactattcaacgctcttaatttggcaagaactgatttctttattcaactgttatatacctataacaacctaattatacaacaatgaaaaaagaagtcttaaaagagcttacagccaaaccggggaaggaacatcatgtatccgatttcaatccctcatttactgctgatatgtccaaacaggatgccaaagaacagttagcccaaaatatcgaaaagctgtcagaactgcaaagtatgctttatgcacaagaccgctactcggttctggttatttttcaggcaatggatgctgccggaaaagacggaacgatcaagcatgtaatgtccggcatcaatccgcaagggtgtcaggtgtactcctttaagcaaccttctgccgaagaactggatcatgactacttatggagaattaatcgttcgctccccgaacggggacgaatcggaatcttcaaccgttcccaatatgaagatgtactgatagccaaagtgcatcccgaaatcctgttatccaacaagctacccggaatactaaaagcgaaagatatagacaacgaattttggaaacgccgctaccggcagattaatgatttcgaacgttatctgactgaaaacgggacggtcatcatcaaattcttcctgaacgtttcaaaagccgaacaaaagaaacgattcatggagaggctgaacgatgaatcaaagaactggaaattctcttctgccgacgtcaaggaacggcaatactgggacgactacatgaaagcctactcggatgtactgacagaaacttcaacagagattgccccgtggtatgtgattccggcagacaacaaatggttcatgcgatatgccgtcgggcaaattatctgtgaacgcatggaaaaactggacttacattatccacagttatccaaggaggcgctggaaagacttgaagaatgcaagaaaaacgtatccgatattaatttctaaacaggatactttctcagagtttaacgggttatttctgtcaggacttgacaaagcccttttaatgttgtatatttgtaagcagaacaataataaacctataaaaccgtaaccaatgaaaagaagtctgtctttcaacatacctgctgtaatgtatcacatgaacggtaacatacagtcaagattgatcagtccgtaaggaaagtacaatattacaacaagacatatctatttccctataacaaataagatatgagtcatcagtatacaagctgaaggctgcgacttccaatggaaatcgcagccttttttgttgccaaatttcagcacagaaagccataaacgggattacatcgtttataataaactcagataccgttttactaaaactatcacaaagtttattataaacacaaacaccgatgattcataaatcatacatttttttcattgtcaccggaaggagaaatccactgttccggttcacgcacttcaatgaataaacaaaaagcgataaaataatacgtttcattgaaaatttgtactacttttgtaaacatcaaagcccaatcatgatttgaccggccaagaaattatgagaccgattaaactttttcaaacgagaatagtctaatctttaagatatcatcaatctaaacattaaagtcatcaatgaaaatggaaacatccgccaaactctattcgctgaattacagcaatgtgaaaacttacctgttcgccctgttattcgtagcaggcaacatcgcacttccacaactgtgccacctcgttccttacggtggaccgactttattaccaatttacttttttaccttaattgccgcttataaatacggctttcgggtaggattgctgacagctgttctttctcctgtcatcaatcatgtcttgtttgccatgccatccgaagccgttctcccgattatactgataaaatcaaccttgcttgccggtgcttccgcccttgctgcgcgtaccgtgaaaaccgtttctttgttagccgtccttggagtaattctctcctatcaactcataggaaccgcttttgaatggatgatcgagggagatttctatatcgcagtacaagacttccgtatcggcattccgggtatgctcattcaatggtttggcggatacgccctgctaaaggcaattgcaaaactctaaactaaaaaagaaagatggacagaagggatttttttaagacagtagctattactggtgccgccatgactatacagcgttcagaggcgatggaaatactgactcagacaatcaataaagcaaatggtgacaaaccggacctggtggccgtcatgggcggtgaaccggaagccatgttccgtcgtgctatcagcgagctgggcggtatgaagcaattcatcaaacccggacagaaagtagtggtaaagcccaatatcggatgggataaagtacccgaactggcaggaaacacgaatccgaaactgatcacggaaatcatcaaacaatgttttgccaccggagccaaagaggtcaccgtattcgaccatacctgcgacgattggcagaagtgctacaaaaacagcggtatcgaagcggccgcgaaagaagccggagccaaagttatgccggcccacctggaatcttactacaaacccgttgatctgccaaagggacaaaagatgaagaaggcgaaaatacatgaagccatcctgaattgtgatgtatggattaacgtccctatcctgaagaatcacggaggcgccaacctgactatctccatgaaaaaccatatgggtatcgtctgggaccgcggctttttccaccagaatgacttgcagcaatgcattgcggacatctgcacactggaaaagaaagcagtgcttaacgtcgtagacgcctaccgtatcatgaagaccaacggaccgcgaggtcgttccgcttcggacgtggtgctggcaaaaggtctctttatttcaccggatattgtagccgtagatacagccgcagccaaattcttcaatcagatacgcgaaatgccgctggacaccgtaggtcaccttgccaaaggagaagcactgaaagtaggaacgatggacatcgacaaactgaatgtcaagcgaattaagatgtaaaccaccatgttaagaaagatacgtatcggaatatcagtcgtcctttttgcactgattactttttattttctcgattttgctaatattctgccgaacagttttcatcgattggcacatatacagtttgtccctgccgtgctatctctcagcataggcatactgattgtactgattgcgttaaccctgttgttcggacgtatctattgctctaccatctgtccgatgggaatatggcaggatgttatagcacgcatttcaaagtctgtgggaaagaagaaaaaaagatatcggtacagtcctgcaaagaatatgctgagatggaccgtgctcggagtgactgtaattgcctccgtatgcggcttctcagtggtattgggattgctggacccgtatagcgcatacggacgcattgtagtacatatcttcaaaccggtgtatatgctgggaaacaacctgctggaatccgtattttccagattcgacaactacacgttttatcaggtagacacctcggtattaagcctttcttcccttcttatagcgatactgacctttgccgccattcttatattagcatggaaacatggacgcacgtggtgtaataccatttgtccggtaggtacggtattaggatttttgagccgttactctttgttcaaagtccgtatcgataccgcaaaatgtaatggttgcggactttgcgctaccaaatgcaaagctgcctgcatccacagcaaagaacacgctattgactatagccgctgtgtagactgtttcgactgtctcggtgcctgcaaacagaaagcgctggtttacgcccctgcttcaaagggacaacaacgttcttccgctacagaaaaacaaccggtggcaacagaatcatcttccgttgctgcagattcttccaaacgtcgttttctgcttgccggactggctactgccggagcagctcccacgcttcttacaaaggcgcaagaatccattgcgacgatggaaggcaaaaaggcatacaaaaaagaaaatccgattactcctccgggatctgtcagccagaagcgtttccagcaacattgtacatcatgccatctttgtgtcagcaaatgcccgtcgcatgtactgaaacccgctttcatggaatacggtctgggaggtgtgatgcagccaacggtcagtttcgaaaaaggattctgtaatttcgactgtaccgtatgcagcgatgtctgtcccaacggtgccatccctccgttgacggtagaacagaaacatctcactcagatgggctatgtcgtctttatagaagaaaattgcattgtcctcactgacggaaccagttgcggagcctgttcagagcattgtcctacgcaagccattgctatggtaccctacaaagacggactgactcttccccacgtcaatacagagatctgcgtcggatgtggcggctgcgaatacgtctgccctgcccgcccgttccgtgccgtatatatcgaaggaaaccctgtgcagaaagaagcgaaacctttcaaagaatcagaagaacataaagttgagatagacgatttcggattctagcagcatcagccccaaatatggatagctttcagaggattgtatacaattcaaaaaaactatccattatattcctcctactttcaataaattcactaaattcgtggcgaactaaaaaaagaaagtaactcatggaggtattcacaaataactggaatagccgtaaatatcagataggctatgctttaagcggaggatttattaaaggatttgcgcatttgggggtgatgcaggctctgctggagcatgatatcaaaccggacattatctccggagtaagtgccggtgcgcttgccggagttttttatgccgacggaaatgaacctcaccaagtgattgaatacttctccggccataagtttcaagacctgacaaagttagtcatccccaagaaaggactatttgatctctgcgaatttattgactttctccataccaatctgaaggccaagaatctggaagagttgcaaatccccttaatcatcacggctaccgatctggaccacggacgtatggttcatttccaccgtggctccatagccgaacgtgtggctgcttcctgctgtatgcctgtcatgtttgctccggtcaatatcgacggaaccaattacgtagatggcggattaatgatgaaccttccggtctccacccttcgcagaatatgcgacaaggtggtagccgtcaacgtaagtcccatcatggcgcaagactataaaatgaatatcgtaagcattgccatgcgctccttccactttatgttccgtgccaatactttccccgaaagagaaaaatgtgacttgctgatcgagccatacaacctctatggatacagcaacaccgaactggaaaaagcagaagaaatcttcgagcaaggttataagatagccaatgacttacttgaccagacactggcggaaaaagggaaaatatggaagtaactccttacttttcccgaaaatatttataatatgaaataaaatctactctatatgaacaacgaaaataaaatgattatctatcaggtgtttacacgcctgttcggaaacaataacaaccattgtgtctataatggagacattaccgccaacggatgtggtaaaatggccgacttcaccctcaaggcacttggagaaatcaggaaactgggtgctacccatatctggtatacaggcattatcgagcatgcaacggagacggattaccgtcgcttcaacatacgtcccgaccaccccgccatcgtgaaaggcaaagcgggctctccctacgccatcaaggattattatgatgtagatccggacttggcaaccgatgtgccggaacgaatgaaggagttcgagaatctggtacatcgcactcaccgttccggactgaaagttattatagattttgtccccaaccatgtagcacgccagtatcactcggatgcacaaccggacggcactaccgaactgggagcaaacgatgacccgaactacgctttcagcccgtacaataatttctactatataccgcagtccgagttgcgtgcccagttcgatatgaaagaaggcgcagcagagccttaccatgaatatccggccaaagcgacaggtaacaaccgttttgacgctacaccgaacatcaacgactggtacgaaaccatcaagctgaactatggagtggattatctgaatggcggcacttgccatttctccccgactccggatacctggataaagatgctggacattcttttattctgggcctcaaaaggtatcgacggtttccgctgcgatatggcggaaatggttcctgtagaattttgggaatgggctattccacaagtaaaggaagcacatccggaaatccttttcattgccgaggtctataatcccaacgaataccgcaattatctcttccgtgggaaatttgactatctatatgataaggtcggtttatacgatacactccgcaatgtagcttgcggctacgaatccgctgcatccatcacccactgctggcaaagtctgaacggaatagaaaagcaaatgctgaacttcctggaaaaccatgacgaacagcgcatcgcttccgatttctttgcaggagatccacgtaaaggaatccctgctctgatcgtttctgcttgtatgaacaccaatcctatgatgatttattttggtcaggagtttggagaactgggaatggacagcgaaggtttcagcggaagagacggacggactacgatattcgattactggagcgtggatactattcgtcgctggcgcaatggcggtaagtttgacggcaaaatgctgaccgaagagcataaacgcctgtacagcatttaccaaagagtacttacgctatgtaatgaagagacatccatcgccaaaggagtattcttcgacctgatgtacgccaataaaaacggatggcgtttcgacgaacataagcaatatacttttatgcgaaagtataagaatgaattgctgttcatcatcgtcaatttcgatagccaactggttgatgtagcaatcaacgtaccttctcacgcgtttgatttcttacagataccacaaatggaaaaatatcaggctacagacttattgaccggtgccaaagaggaaatctgtttattgccttataaagccactgaggtttccgttggagcctataatgggaagattctgaagattacattctgatctgctccgattgaaggcaaatgataaatcaatagtatcttaactctcctccttcccgaagggaggggaattgatgatactattgactttttaggcagccccaatggagatactactgatttattctccccaactgaaaacaaaaattctcaaaggctgtttagttagataaataatttcctaaaccagaaccttatgaagaaaattagttttttggcagtcatattattattgtctgtatctgccttcgcaatcttacctcccggcaatatacaggctgccttcaaaaagatgtaccccaaagccaacggtatagcatggtcgcaggatgatggctattattgcgctaactttgttatgaatggattcactaaaaacgtctggttcaatacgcaggctcaatggcaaatgacacagacggaccttgtcagtctcgaccgggtgacacctaccgtatacaatgcctttgtatccggtccttatgccagttgggtagtaaatgatgtaaccatggtggagtttcctaaatggcaggcaatcatcgtcattaaggtaggacaagataatgtagatatcaaataccagctcttttattccccgcaaggaatgttgctaaaaacccgcaatgtcagttatatgtacgacattctcggtccgggaacattcttataaaaaaagcccttgccaaacattaaatgctcggcaagggctttcttattttttattccctgagttatttcttctttctcaaaacaacagctgtacgtgcaggaatatagagtttcagccactctttcttttccttcttatacaacggatcggcaatcgtgaaatgaactactgaatcatctgcaagaccatttccgccaaatgcaacattatccgtattcaagattacttcataagctcccggactaacgaggaaaccataatctacaaaagactgtttcggattgaagttaaatacaaatatcagatccttacgtccataagccaatacctgatcaccatcattatgccagatctcctggaccggagtcgcctggaaatctttcacactcttgatcactttcagcatctcagcatcaaagtcccccatgtagtgataagccagattcttgttatctaccagatcccactgacgacgggcatacttacaagaccatccattaccttcacgcggaaaatcgatccattcgggatgcccgaactcattacccataaagttcagataaccgccattgatcgtcgaagatgtcagcaagcggatcatcttatgtaaagcgattccgcgattgactacataattctcatcgcctttctgcatatgccaatacatatcggcatcaatcagacggaaaataatagtcttgtctcctaccaatgcctgatcatgactttccgcataagagatcgtcttttcatcctgacgacggttggttacttcccagaacatactggaaggtttccagtcctcatcaatcttttccttgatagtcttgatccagtaatcagggatgttcatagccatacggtaatcaaatccgtaaccgccatcttctactttggcggcaagtcccggcataccggaaacttcttcagcaatagagatagccttcggattgacctgatgaatcaactcattcgccaatgtcaggtagcaaatggcattgccgtcctgatgaccattgaagtaatctccataattacagaatgcttctcccaacccgtggctataatacaacatagacgtcacaccgtcaaaacggaatccgtcaaacttatattcttccagccagtatttacagttggacaataagaaatggatcacttcatttttaccataatcaaagcatagtgaatcccatgccggatgctcacgacgaggagccggatagaaatactggttcggatcaccggcaaagttgcccaaaccttccacttcgtttttcaccgcatgagaatggacaatatccataataacggcaatccccatctcatgagcagcatcaatcagcgctttcagttcgtcaggcgtaccaaagcgggaggaagcagcaaagaaactggatacatgatagccaaaactaccataataaggatgctcctgaatggccataatctgaatacagttatagccttcctgtgctatgcgtggaagtgttttttcgcggaattcattgtatgtgcctactttttcctcctgttgtgccattccaatatgacattcatagatcaacaaaggattcgtagtaggcttaaatgtctttttcttgaatttatatggcttttccggtgcccagacttgtgcgctgaatatcttggtctgctcgtcctgcaccacacgtgtagcccatgcaggaatgcgttcaccttgtccgccatcccaatacacattcaacttatataagtctccgtgatgaatggcatctgccggaagattgatttcccaattaccgtttttcagttttttcagcttataagcagctttctcttcccagttgttgaatgtacctaccatataaatatgagtagcattcggtgcccattcgcggaacgtccatcctttgggagtacggtgcagaccaaaataaagatagcctgatgcaaagtccgaaagagtttgttttcctttattggtcaactcggcttccttgttcagtgcatactggtgacgaccggtaatggcatctgcgaaaggttccagccagggatcgtttttgataatgttgagtgtctctttcatatcagaattgaattaggtttatgcttttacttttacgatcactttcttcactccatcaggagtaatgccgggagcatgtccgtcttgcgggaagaagatggcaaacattcccggtttcacagctacatatgtctctgccagtccttcgaagaaagtaatatctttttcgacattataaggagcgtcggcaggcacacaatctttggcagcagtataccccatcacttctgttcccgacaatgggatctgaatatcaataaattcattatgcgtttccaatttcgcctcttccttagtcttaggctttgtctgtgcgatattcactagcagatcttttcctttcagttcagtcttgcctatttccatggcttggaggtcatgagatttcaagaactcaatagcttgtgcaaacaaaggattcaaagacgcgtatttttccagattttctaaagtatctactaccatatgagtttaatttttaagtttatatttttaggtattattttattcaaaatcatcaattgtgtaattgatgaaatcggcaaatctcttgaactgtcggaatgctttctctatctgctccatcatgtctgcccgagtgaaaaaatcatcgggaacaagataagaacagacaaactgtctgcacttcagataatcaatatatttaaaatctttcgggaatcccttgggagctgttttcatgaagtcctctcccactacaggaaaatattttttgaattcggggtcttctacaatggagatatactcttccacattgtcataaatggcttggcggacagctttcagtacattgggaggcaaacacaagcttcctccggcaagcatacttccgtcaggctgcagatgcacatagtatccgcaatgatcggacttcttgcctttggcattgatataaccgccaaaatgtatcttatagggtgtcttatccgcagagaagcgggtatcccgataaatacgataggtacaatctttgggctggattccccggattgtttcatcgaacaaagaaatgcgggcgattactgttgccagaaagttatcaaactcggcacgggctacttcatattctgaccggtgctcattaaaccactcacgattattattcgcagaaagatcttttaaaaactgaaagataacgggtatgttcatcttcatcattttctattattaccctacaaacgtacaaattttatttcatataaactacaaaacgcaacaaaaggacataaaaaaagcatcggcctggtaaaaccgatgctctaacacatttatcaaaaaaacagactcttctgcttctgatgtactctaagctttcacaagtgaagtacaatctcttttaattaatctttatctaatactatgaaaaacacataaatataacagattaaaaagaggctttgttcaacggttctgtatatatttccgttaattttagttatagaataaaatatttttcattgacaggtatgatgagccgtttccagtctatcatcgcattgaacaacatgatatgggagtaatcgcccaattgcgcctgccggatatctttctccactatgaaccgattatccaacagttccgcacgcttcgtcccctgaagcaagggatgagccggagtataccatgtatgtccgtcatacagcgctatgttggcaatggaggtatcagtcagatatccgtctttcactatcagaatatcgtctgccttccctctccgggcaaacagatcattcaattcttcccgattggtactcttgtaactataatcaatagtgtccgaagcaaccggacgcaaggaagaaaccattctcatttgataaggagtgtatccgacctcttcgatttccttatcgtacacaatccggcacttccagataccggacagagacggaggagatataaagccggacaaatcaatgggagccgcttctttccaaaaggcggcacgagtccggttcatgcgcgctgtgtgatacgacagattataaacctgtccgtcttctatgcgaatcgtttcaataaattggcacatatactttttgtttcatttcatgatattcactttccacttcactacggcaggttattccgcctccgctcttaaaatacattctgtcgccttcctgctccacaaaacgtatcataacggcactatcaaggctacttccgtcgaaataccccatcacacccgtatagaatcctctctcatacgtctcggcttcactgataatctgcatcgtctttttcttgggagcaccggtgatagaaccggcaggcaagagtttgaaaagaatgtgtcccagattttcccgataattatccggcaaggttccctgtatttcagaactcgtctgaagaatagttccgcgattcgtctgcaacttatcaatatacctgtatcgggacacagatacccgatcggccactatgcttaaatcattgcggatcaaatctacgatagtagcatgttcggcagcctctttcggatcatccatcagctgccggacagccgaaggcaatgatgcatcaagagtacctttcatcggataagaactgatttttccctgttggattctgacaaatatctcgggagagaaaactgtgaactgatccctgacccacaatttatacattgcttttgaacggaagaaaatatctttcagactaaggttcgtctctatcggcgtgcggcatgtcagattggtcagaaagctgtttccggcaaatatattccgttgaacgatatcaaatgaccgacggtaactatcgaaagattcgggataagaattccagtggacaggttcttcaaaacaagaaagcacatccttcgatgaagattggttggtaaacccattcaggttatatactacttcagaagggtcaacagaggcaacttcttcaatataagatgcatcctgcaaataattaataataaaaataaaaggccgacaggattgccctaaatggtttattttccgaatcgtttcttctcttgtatataattgcataaagtctttctttttgggaaagcaaaagtacgcaaaaagtagatcattcaaaaaaagaagcaataaaaaagggttgccaaaatgttccccggcaaccctttctatctggaattggtagtttacttcatagctgcctgcacttgagaaagcatagttttagactttgtatcttccggagaaactttggtagcttcttccaagtaacctatagcttctttaaatctgccatctgccttttccttttctgcagcatatttgtctgcatcagagtttgccagaggagcagcctttttcaggatattcgcaccgtcgttatagcataaaacgcccaggctatacaaagcattggttttatatgttttatgatccaaaggaatcactttcttaaagcattcttctgcttcttccacttttccggctttctgcgcagcgatacctgctttcaggtagtggagaccatagttcttaatcattgttttattgtccgggtctactttcagaccttcttccaaggtagcaacatactcgtcagtcttcttcatagcatccagtgccagcgctttacgggcataagcattacctatattgaatttcttttgaatagcaatatcaaagaaagtcacagcttctgcatactttttcacttcatctgcagccataccacagtaataagcgattgcagaatcctggttattcgtttgtttcagatactcactgaatttagcataagctacgggatagttcttggcattaaaagcgtcgcttccttcttttttcaattggctagggtcagtttgagcgaaaatgttagtcacagtaaggcaaaatgcaaataaaaaaatcaatttcttcataactttattgtgttttttagttgttaatcgtccaaaagtataagtaataacagagaatcgcaacatcattttaccttttttgagctttttgaaacctatataacgttcgttattcttcgtaaaaatagatttgcgagtgtccggcagggaggaaaaaagacactccttccgcctcaataattcagcgaaaggagtgatattcaaatagtttagttattggtcagatagcgtttttattagcatattcggaaaactcacagccaaaagtatccaccagataattatccagatcatctgccttgaaagccagatgggtcagattcgtcttgacattttccgaataatcggagaatatatcagatatatgcacacgataagaaagataaatctgatttccatccagtccgaaacgataaggagcaatctctgtctgaagtaaataggtcagcacaggttccagattcttttttggcagaatattcagcggagaggtggcaaacagataagaacggtcgtacacaaacatacgtatctccgaacttcccttatagaatttccagccttcgtatcccacacgtgccaataccggattgattcccatcgcttcaatggcttcttcgcagaatacagccagatcggtcagtcctctctctttaaagatttcttccggcaacttgtcaccgcaacaagggcaatattcatcttcttcggaaatgaattcatcgcaactattacactgcacattgaaaacagagcgatccagactttctatattctccagcacctttttcagtgtatccacagggataccaaatcccatattatccgcatcggtgatcttactggcggtaatggcgatcaattcaccacgttcattgaacatgggacctccgctatttcccggattgaccgcagcatctgtctgaatataataactgttgttaatcagctgtctgggagaagaaaccgtaccttcagtcacggtgaacggcataccaaacggatagccggccacgtttatcttctgtccgatcgcgacttctttcaactccgataaccggatatccggaagagcagaaaaatccccttccaccgacagcaaagcaatatccaatacggaatttaccataacgaccctggccagaaacgaattcttatcattatcctggatcgctacctgacggaatccctctactacatgataattggtaacaaacagatcatattgtttcagataaaaacaactgccgcagccaccggcatgattcactttataaatggcattgtatatattctgttccatagtcttgttctttatttgttagtgtcctcttccgtattgttattgttgccatacataccggccatcatcttttgcatattctccatagcaagttgctgcatcttctgtatttgctccatatcaatattctgcatcgcctgctgcatcatttcctgttgcatctgttgaagctgtgacatatcgaagcccattgtttctccgtcttcgtcaccaccttcttcgtcatcatctacatccagttctccttccatgatattatccatcgcttcatataatatcggagcagcttcttcccatgacatggcagaggtagccttcattgctttcacaactaccgcattcacatcattctgcacattattataatagtacaattcatagaatttattaataataagcaggcagcaaacgatgaagtcacctgattccaatgccgagccggctttctcgtatgcatcttcaaagttatcctgaatgtttttcagtacggaacggcgtctgtccgaaatgaaagtttcaacaaagtaaagatcggcagccagttgctccttcgtcatttcctgaaggcgtgtgacaacagatttggtacgggatacgatctccggcaacggcatatcctcccgcccatgatctgtaatcgctttatcaagatcattcagcagttgcccttgcggacagacaaaatagcatattttaagaagcgtactggataatatattccaggcataaccatattttcgttctgtctcgaagtattttacagcgtccatacattccttacagctctgctggagggcttcgtataccttatccaccgtttcattgtcgtatggagtaattttgggctcataaatgcgctcggccttgaacttagtcacaaattcgtcatcatacttatctcctatccggcagatttcctcaagcacatagtatatcttgtaaggattgcataaagccaccggacaatgaaagtcaaagaacaacttatcattctgcaaagagatacatgctaacgtcagttctgtcagattcaaagctgccacctggcgcagcaaaggaatcctccccttttccggcaacaacagaaatggagctgtaatattcagctggtcaccctccagcctcagatagaccataatggaaccatgaggtacggcaaactctgtcccttctgcattaccaaatttgctgcgtaactccggatcaatataatccagcaacagataaaaagactgtaagtgctctcccttttcaaaagcatctgtactcttctcaaaagcttctacatccaccttgctctgtgtagaagcaatgatcggactatgaaaactcagtgtttgtttcataattctaatgtttggtttaacaaattatttcattctcattcttaatcatttaaaagtcccgaagcacagcctccaatgttgtttcctgcgctatccccatcttttcggtacgaattcgtttcagtcttttcttcaccgaatctttctccagatgcatgatcttagcaatatcagtctgcgaaaactgcattttcaccatacagcaataccgcaaatcctcctcattcagtgcaggatactgattcttcagacgttctgtaaaattcaggaagatactgttggcattcttgaatattactttccagtcctcatccttgagcattatattctgctgggttttcggattttcaatcacaggaatacaagtttcattcaggcgcttaaaaaactcaacctttagtaaagcctctttctcccgaatctgcgcttccctttccttagcttccgacaagtctttttctgcctgtagtttttctatttcacggtacttcaacaactcctgctgatgggcaatctgtcctttctgacgcaatacttcctgttgtttccttttatataaaaagaagtagatgcatacccctaacaaaatcgccaggcaacaaacaatagtcacaacgtacagttgcagcttcctttccaccgcctgttgccaaagacgggtattggcttttttcaattcatcattgtgataattccggtgcaaagtcagtaaaccttccttatctctctcctctatgagcctatcccgcaagtcagcatgtcggttcatataataatatgccgaatccatctgcccggtagcagcataaatttcagccttagccaaagactttcgagttgtatattgtatatctgttgtatcttccaccgctttattaatgtagtagaaagcagaatcatactgatgcagttcagtcagtgtgtttgccttatttatataatgatcatagatatattcattttcctctccgaaaagttcaaatagaatagccaaatctttatcgcgatacatcaacgcctgtttatagtccttcatcgccatgcaaagatgggcatgctgtgaataaatatgtgataatgcccggaccaagttctctttctcagccagttgtatcgcttgcacagaatatttataggcgctatccagttgatttgtctgcataaatccgtgagtgatatacggcaacagtgcacagatatacaaagggttgcctgtccgttcggcataaggtaacgctgccttccccaaccgtagttcctcatcaggaatcagtcgcaagttgaaaagacgactcattttatacctgaccatgaactgaagttcatcgttatcactctctcccaaccaatcgattgtctttaggaaattatgcagggaagcttccgaatcttcattatccattgctaccagaccggcattataataagccagtgccgcatgaacagagtccgtggttcctttataataatcaattgcaacagatataagtgaatcacttttatgctcctcatcagatgactgattgatcacctgagtcattagcaatgcatacaaagccctatttgaatccgacagcttctccggatactgaatttggcgaagtaaagaaagagcgctgtccggtttcagcttgatcaattgttcgatagataacaatcggtcggctgtatgatgacaagcagtcaataagaatcctaacaatataaaaagtacagtttgtcgtaaatgcttcatgaacaaaaggtttatgtttcccaactaaagagacgaatctctgaatgcaaatgtaggaataataatgggagttgctttataaaatagggggtataaatatattcttaattaaatcaaatatttgcctgtttatcaaatcaatatagtatacagctaatagtaatggttattatttggcgggtatttttaatggaggtgaaggacctacttttccttctactagagcagccggcaagggtaattatccatataatgtagaaataattccatatattaacataataaaataagaaatatgagacaaacttattattttctgtctttcgtgttacttttatttgtattcatttcatgtagcaatgacgtcgttggcaagggaacagatacgataggcctagagactaaagaggtattttttaaatccagtaaagattctatagagttacgaaccaggaaaggtgacgactggtggctgactgaaatctctactaaagacacgatatatagaacacactcccttaatgttcaagtaatagaaggtggtggactttatgtggagaaaacaggtcgcaaatcaatctttatcaggattgattcaaatttaacaggcttggaaaggagatttacaacagttatacaagcagggaattactataatacaattactataatacaaaaggccaaagaataaataaaaaggtggagactgctattctccgcctttttgtttacttactttttagttctagaactaagttttatatttcaagtgatactataaagaatcaacctccattaaaatcagctattgattttataaatggattacgggatcttccaatgaaacgtatggtggctgacgaaggtatccttgctggaaaattaataataaattggacggtatgattataaaaaaataagtttctatgtttaaaatctgaagtgacggataacagtagatagcactaaaaaagctataccattttagtaaacttcatattatattgaagtcataactcattaactaaaacgatatagcttatgagacgtgtacaaagtaacacattagatgtaggaattgatgtccacttaaagaattggtcgacagcaatcttatcaaagcattcagtactgaggagattcctgcaagttgattgcgagggacctaccctcatctcctacatagttgcgaagcatttagcacatgcttctcgtggcacaatctcaccctaccgtacaaacggttccgcatacggcggtttcgcaatctatatgtatttgcttataaagatgagataacattggataccccgctttccgaagagactcgtcctcaatagcattctgaagaaaggcacgcgtacaacgccaataccctttccgagtatttgcccactcctaagccttacctttcggtattccacatttctgcaaatttgaaaagcgagtcttcactctcttccaacatttccatatacacatacgcaagtgtctgcgataccattggtctaatggaatcagcagactcctcatgtctgcatatttgaaataccctatccaacctctaaaggtttgccagagtatctctttacgttgggcataacccatgctgttactacgtctggtaagagatttaaccttacgtttgaatttctcttttgttgtcttgtgaacacacagcctgcatttgcctttcgtgaaatagaaggaaaagtccgttatgcttgagcatacgcgttcggcggacctcttacttttgcacagtatcatgctatcatctgcatagcgtacaaagcagtgtccacgtctctccaattccttgtctagttcgttcagcaggatattgctgagcaaggggctcaaaggggcgccttgtggtgtaccctctatacttggttcataatgcttacctatcattactccgcttgtaagatacttgtgtataagagaaatgacacgcccgtcatttattgtccttgatagtattctcagtaagaaactatggtttaccgtatcaaagaatctaacaaggtctatgcctacagcatatttgtagccttcgcttgtataacagcacacttggagcaatgctacatgcgcactacgtcggggcgaaacccaaaactgcttgggctgaactggcgttcgtagataggcgatagcacttggacgatggcttgttgtatcaagcggtcaacaacggttgggatgcctataagccgtttcttcccgttatccttggctatatctaccctacgcactgaattcggtttgtaccttccaatgcgtatcgactcgataagttctgatttgtgttcatgaagatagggaagcagttgcttaaaatccattctatcaacacctccaacccctttgtttcgtaccacttgtagataggcacgattgagattgtcgggagaaagaatttgactcattaagtcatctttatttggttgcactgctatcaaactgccgtctttcatgtccatataggtctgcactccctcatagctttcggattccatcctattcttttgagggtagccaagtgtactttctatgactcttattttatgcattctttcctatttagagttagttacgtgtttatagctattgcgattcagcccttccttaaaaagaacttaagtactatggcttctgctgacttctcacaataagctttactccgtgtttggcaatctaaacacatgctccacacgtccgtgagacctccccgattaagaatataatctttcacacttatacctgcttgatttacaccgagtgttccatatagctatagggctttatcttgtttggcagacttacccacactcatatgccttagtatcaagtttctgtacgtcaggtcagtgctttgcctaagacttcctttagatgccgaatcactacggacaccattgccgtcggctgtacgcttgccgatataaggctgcgatggggacttacacccattagattatgcccatgtcgggcaaactccaaaaggcaactaactcgcaatgaattagttgccttaaattttcctattttaggaatatccctagctaatggtacatcgggcaaacattctcgatatttccacaccataaaaacgagcaaagacttgatacggttcttggtatgtatgctgtcttttgcaatcaggtttcttagtcttataaagagcgtatttttgtggtttcctccccagaatataattccttttcaaatgaaccgaaaggtaactcgtgggccaatttgctacaattcacagcattggtcttgcgtaacttctccttgctcatggtaggcacatcgactggattaccccgtaaatgttggttattcctaaattcatcagcctctcatacatgcagaatctgcagaaaccagcttcattgattaagaagtaattgtcacccgaataattacttgccaagtactaatgcaaagctttttatttttttatgataaattcatccagcatttttccgtctcgatccattacctctatcttcatctgtgtggtcgtggcataaatacgtagcaaagatgtattggaattaactactacggggaaagacgttttgtcagtggcatcatgacgcacaaaacgatgtaagtgtccacaaagcattaaatccggataagcctggcgtaataaaggcataaacttctgctctacttctacatttccatgccaatcctcatcgggaccagcttcagtaactgcgggaggaatgtgagctacaattattttaaaaggcgcttctttatattcggtactttccaaaatactggccaaccattcggactgttcggtacggtagaggtcatattgggtaataccggcatattcaatatcagaatcaggcttatcttctcccgtatccagaacaatacaatagacaggaccttgtcgaaaggcataataaagatgttcctgacagggagaaaaataacgttggatttcggttgcaaatactccccgtgtttcgtggttgccacgggcgtagtacatcgggatctcagaagcgaaaagtcgtacagccgtatccataaaccccttgaaaagctgatcttcactatttatgaaagagagcatatcaccattaaaaagaacaaagtcggtttgcgtaaggttacaacgggacattaagtcctccagcagtttgttgtccccatgtatatcgttgaccattacaaaagaggtggcaggcgcttgcggattgcaggtatgaaaagtaagcggtttacgataatagacatcagtggaagcataacttccataaatgattttatacccagtatgtttcaacacttcctgagcaaaaacacggtaacgatattgttttcccggtgtcagtcccttgactttaacggcatggatggttgatgtattcttgatgccattagacgtgtcaaaataacgcggatgctctttggcgtaaaaactgccgttgccatctgaggccagttccacccatcctatagagggcttatccgttatccatacaatggtagcttcgttagatcccacgttttgcaagtaaggtccatgagttattgttattttggaaatttcatcttgcgaatacaggaatgtagctattcccaataataacatttctaagaatatgatttttcttatcataatgcctaatctaataaattgttaaactttcgtatgtggaaatctggcagacagagatgtatccttactttaccttcggtatctggtttagcctgcctccttcattatatcgttgattattcggtaatccctttttattcactcccttttgcatgagtgattttaattcctccaaataataatggtatatgtcacggggagtggcttgatattttttgcatagtgaggctgccatgcctacaacttcccccatcatacctgtagtgcgcataactcgtacggttcccaaggcaacatgtgtgacactgatattgcgtcctgccatgaacagattgtctatattacgggaataaagacatcggtagggaacaggatagggataaattactacatggtctgtcgtcgctttgaattcccgtcccgggaaataccgggtattctcggggtcgggccggtgcagatcaatactccaggtagtagtgaaagatgcgtcctcatgggctacgtgctttgttaaatcatcctctttcagtacatagtcgcccaatagcctccgggattcccgctttccggcaatgtaggctacccattccaatgaacgttttttataatattttcttcgttccgattgatttttcaagtagctccaattagaatatataactaacattccatagtcacgtatttgttcagaatcattaatctgatttttattcattccggtttcccaagtccattcaccataagtgacaggttcacaggtctcctcattgaattcgatgccgtaccggaattccggaaaataggatgtttttgtgtcttccacagaataccattgaacagaagtgcccattactaagctatcagctatttcgggagctatagtctcaccgtattcagaacggctttcacggcccatacgatagtctgccccggccagataaccgatagtgccatcaccagtacagtcagcaaataaacgaccataaaattcgatttcttcaccggattcaatatgacaagcggttatcgagatgatccggtcctcttccttcttcaccgaaaatgcccgataattaagaaacagggaaacattagtttcagcttgcagccattccatttttttatgatcttcataattgcctgccggttgtgcattaccctccttgacgggaccgaactctttttgcagcccccccagttcaggatattttccgatctcgatagctcctcccaaatgaacacgaatctcggaactattgtttccaccgactacagggcgatcattgataagtgcgactttacagcccaggcgggcggcagatactgctgtactcatacctgcaatacctgcacctataactactaaatcatatgattctgtttttgggggggctaataatccaagtttagcacgacgaaagttatttaaagccgccatatccgatggcggaatatcatctttccgtgtcgtaaaataaatagcatcacaccgcccgtcaaaacctttcaagtcatgcaaaacaatgtgaatattcttttctgttgcctgatattgcccggcatactgccatatccactgattgcctataatacccaaccggtaagagattttctttccgtttactgacaaaccgaacaatccgggcccttcaccctcctgccatggagacgtccagttgtaggtgcgtacaaaaatataatatgtgccattttctggaagttgtacattggtactcgcattttcaacaggactacctagaccgtgtgccagtaaataaggtgatcccatcaagtccataaattgttggtccactacccagcctcctttttccgtgaaactttctgcttctaccaataaactggcagcatgaagactcgctccgtgaaataccatccagatgagagaaatatatataattttttttatcataacaattttcattattcttatacttgtttattcatagtagcgaaggataatctccttgatagtcagccgggccatcagtggagttgtcaattccattttgagggctttaatcatggctagtgtactgaaagatgctgacaattctccatttttgttatctgcagctactttcttaaatattgtaccgtcctcgctgacagataattgtacatgttccggatgttcctttgaaacatcaaacacaattctgatttcctgtactgcttgtcttttttccaaagtaagagtaaaataatctcctttttttaaggaatagggggttgcaaagaaagtctgtatatcaccgtcaaacgcatattcaggcatataatacttgattcccttcatattggtatcgatacgggcaggacatacaagacggggcctttgttcgctttgcggaacaaaacctgtgttatcccaatcctcgtctttgaagtaacagatattcagtttttccataatagcaccgaacttgctgatacgttgtcggaacccttcccattctttcttttctttcgtgttccagagggtttcggccaaggcacaagttctgggatataacatcctttccacctcatccgaggttgtaatgaattcagtccacaaattagcctgtcctcccttgacgagatgtgcttgagtattcgtacattctttgccaactggttcccattcatacaatctgcgtgtggaattccgtgaatacccgaaatcaaagtaacagggatccttaggagacataatgactgacaaccctcttttcaaagctttctgttgctgttctcttccatcacgttgccagatcatgatcacgtcactgatgtcagcggcattacggtcatttatttcatcccaacctatcatcctttttcccttggaacgtacaatttcactaactcgtttcgtaaaatagtcctgtaactcgtgccatgaagtcatattctcttgtttgtaaatcttttggcatttcggacattgttcccatagatgtgtcgacacttcatctcctcccagatgtatgaatgatgaagggaagagatcagtgagttctgctaccagtttttccacaaacctataggtttcaggatttcctatacacagcatattctcatctgctctcttccgtttttgtccgtccagttcctctggataggcttcaaattttccgcctttacatgacagttggggaagggctgcaagcaaggccagacagtgtcccggaaggtcaatctccggaatgatctctatgccgtacatggcggcatagttgatcaattcctgcaactcgcttttacgataataatgtcccgatagatcctcgaatgtccggtagtacgtacctttgaacgctaaatccggatattggtccagatacagacgccagccttgattgtctgtcaagtgcagatgtaaagtgttaagtttaaaaaaggccaattgtttggtatactttttaagttgttcgatagtccagaaatggcggctacaatctatcatgactcccctgtaactaaaacggggtttgtcgtggattatgaaccggggtaactcttttccctcacttcccagaatcaattgtaaaagagtggaaaaagcatgaatcatacctgtctggtcacctgcttctatgatgatcccctgctttgtaatttccagcatgtacatttccggctcctgcattttcaccttttttacatgaatggaaggatttgaggcattcaccatgacagacaaatttgccagttctttcagatcgctgacaaggaggtttcctgtatttttccattcgtccgggaaatggatgctttccagacgttcgatggatagcgtaccttttttccggaccatgctttcaacttgcgggatcagacaaatattatcttgagaataaatactgtctggtaatatgagaagaaatagaaaaaggtgaaaaatatagctctttccaatcataaagttagaaaaataaaagggtgaataattaaggagttaccttttcccggactatcaacaactttcctgcatttaatagccgggattttgttttaagttctcgttgatctgaagttccgtagtagggataggccacaaatattggcgatcgttccaactacgtacagcaagtgcctgacatttacccgcttcttccaatttggagaaatctgcacaaccatcctcgtccatttccggtgtgaaagcccaaaaccaatctccctgactggttacccgttcgatacatagtgaggccggataaaggataccatatgtcttgcgattcataaccttttcggccagtttccaacggatgatatccgtatatcgcatgtgttcctttgccatttccatacgacgttctacacgtagctggtggcgaagtgtggactggtcgttagaagtgaaagccggataacttgccttatcggacttgtccacaccataagcacgcgcccgaacctcattcagtgcatccaatacggagttatctatctcatttaattcgattttcgcctcggcatatgtcaacaatatttcggcataacgacaatagataatatcctggtctaccttgaaaccattctgaagccatgtttcgtctatcccttttttccacaccagaccatcgaaagaagcatattgggcattggcacgtgtatcataatttgtcacgatttcacccgtattatagttcatacacgtcagtgcctccgggtgtgggttgtattcataaccgaggtggttggaaccaaatggtacaatggtttctgctaaacgtgggtcacgatttgcaaatggttcatgcggatcgaagagtggtgattcgttaataagcagaccgtcggtacaggtgaatgcagctagtaactcccatgacggacaggtctgcgtccatcctcctacgttacggggtagatcattgtatacctggttaactcctccgtttcctgttcccagataaatgtcatatgtagcatcacgtggaattttgaaaataaattcattcgagttttttgtagtagacaaaaaaagattgccaaaatcgggatgcaattcataaatattcaagtccataaccgccttggctgcatcggccgctgtttcccaatcttccataatcaaggcaacccgggcttttagtgccagtgcagcaccttgggtggctcgctgttggtcagtataggaagttggaagcacactaattgcatcatcaaaatctttatagatttgtgccaatacgatggatttatccgtacgtcccattgtcaacccttcttctgtacttacatcggttaataccaatggtaagtcaccgaactttacaatcagtttggcataagcggcagctctatggaatttggcttcggcaatcaggcggttaatagtagtggcagatgcgccattttcgatagcacgatgcgatttctcaataactgcattggcacgtgaaatagctttgtactgattgccccataaactggtaacccaagcattttgtccatttagagttccgtcatcaaaagaggtcaggagatcgcgtgaagtatagtcgtccgaccagtcggtctgttgttgtccgtcttccggccagaagtcatatcgatataactcatcaacggccatctgcacttcagtttccgtggaataccagttttcagtagaaccgcttgacaatggatttaaattgagatcatggcaggcagagagtaagagtattcctgccccgatatataagagtaactttttcatgttttttatggctagaaattaatagaaacaccaaatattagagaggtggtaataggatacccttctgtacttacttccggatcccatcctttgggggcattactgatggtaaacaggtcacttccgcttacataaagacggactgtattcatacacgccttcgtagtccatgctttggggagcgtataaccgacagagagattttttaaacgaatgtaccgaccgttgtaaagccaataatcagacatacagaaattagcatcccgattggtgcgagtcaggcgcggatatttggctgtcgcattctgctcatccgtatttttcggactccaataattgccgtcaagaatagtagggaaattgagccagttgtctcgaagcccttcaatcattgcagcactgatttgagatttctgacttccaacaccttgtagtgtcaatccaaagtcccagcctttataggcagcattgaaagtgagtccaaacatatagtgaggcagggaaccgcccaaaagtacacggtcatactcaggtgagataactccgtcggggacaccgtccggtccggaaatatccttgtacttaatatcacccactttgacgctgttgttcagtttgggcgacttgtccacgtcttcctgagtcaggaacaagccatcgcttacgtaaccataccattcgttatattcacttccttccatttttacctgattgcctaggaactgtgtaccattcaggtttcccattttggaggtaaaatctgacagattagcggaaatggagtaagtgaaatcaccgactttgtccctccagccaacttcaatatcatagccggtagtgtgcatgtttccggcattgacttccgggttgtcgtagccgatgaagtgtggaatttccagtgccagcaacatgtccttcgtattttttctataatagtcagcggagaagtgcagacggttatccagaaaattagcatctaaaccgatatcccagctttctgttgtttcccatgaaatatctcgtacggcatacttctgctgtgcggccgtagtcacggaagaaacaatcccctgtgaattctgaaatagtgcagtgctgtaatcaattgcagcctggtaagggtaataattataaataaagttaccgtcatcgtcataagccccgatacgttcgtttcccagttttccccaagagcctctcaatttcaggtaagaaaaccaatccatatttatattcttgaaaaacttctcttcagaaattacccaaccaagtgacacggaaggaaaattggcccaacgacaattggatgcaaaacgtgaagaaccatcccggcggagatttgcttggataagatagcggtctgcatagctataggtcatgcgtccgaataatgagcggtaagcatattcttccgcattgccaccattatcccgataatcctccgaaccgaggtccaggtaaggatagcttgtcaactggtactggtctctggatgcatccaggttttcccagaaagcataataatcctcgtaaccgatcatgacagagaaatcatggcgccccagtgtcttggcatagttggcaaagaactgtgttgttatatcatggctgtcattacgattttccgtcaaattggtagtgcgataacctcccatgtaaccaacagtggtattcggatcttctgaacgggtgtatggaatctgtttgacaaaagttttcttctttacattattgaaattgggcgccacggctgctgatattttcagcccattgacaggagttatgtcaataccgagtttaccgccaatattggttccccagttggtaaaagtgccgccatctgtaattttggccagcatattttctccatctttcacatcaccccataagccattggtccatgtagcagcataaattggcggaatgtttcgtccacctgcccccatggggttggaattaggcgagagagctttagaacgggaaaagttcaaatccagatttgcggaaatatatttatttatattgaaatcattattcacgcgtaccataaaacggtcatattccttgtttacatagaggccgtccgttttgtcatagcggaaagaggcttttgtacgaataatcttacccccaccaacaatgcttagagtatgtgtctgccggggtgcggagcttttcaacagaatatctccccaatccgtcataggatatttgtccggattagtcgcattatttatgctccagttggtaatttcatcttccgtatatgtttggtaccatccaccgtctggattatcgttatagcgtgtttcatttaccatttccatgtaacgctgggctcctacataggtcggcaacttagtcggtatttcccacccgtactcaaagttgtaactcaaagccacatcaccgctcttggcacgtttggtcgtgatgacaattacaccggctgcggcacgtgaaccgtagatcgaagccgaagcagcatccttcaatacggacatactttctacgtcttcaggatttacggagttgatatcacccggaattccgtcaataatcaccaacggactggaatcaccaatagttgttacaccacgtatctggatagaagcactactaccgggagctccattgtcacgactgaccattactccggaaagcgcgccttgcaaagctgtggaaagttgggtggtacgacgggcagcaagttcgtctcctttaacagctgttaccgaaccggtgagatctttcttcttcatcgtaccataccccactacgactacctcatccaattgcgcattgtcttcctgtagaataatgttaatattcctctgctcgccgatattgacagtctgcgtttggtagccaatataggttatttgcaatgtagaattggcagaggcactgatactgaaacgtccgttcatatccgtaattgtgcctgccgattttcctacgacttgaatatttgctccgataataggctcaccattttcatcttttactatccccgtaactaaaaaatctttttgctgcgcacccttttccttatccgtagagttaatgagcatgatgtttttaccttctatagcatggcgaatgcctgtatccttgaatatatcattcaaaacttcattaacggctttatctttcgcattcactttgacattacgtttgatattgatatcttttacgttgaatacaaacagatagtccgtttgtttctctatttcattaatcacttgtccgattgttatatggttggaaacaatcgtaacatgagctgtctgcgcatagcttcctatagctagaagatttcctacacataagaaacagacgtaaacaataattttcataatacggaataactgtttattttctataaataattcctggtatagagaatttttcatattttcgcaacatattagtttattaggtttaacttgatctagaactattttgtcagttggtataaactgatggaaaatgtgggatggtgttgcagcactgtccccttttcttttttaaatgtttctttattgtttcataggcattagaaatattaaaaagttaattaatggttatcgtattgctctcgttatctttaatataggtaaatttattattgagggcaagcacacgtattacatgttcaatcccatcatgggtccggaattttccggtatagtgcgcatcaagaatctgttgattgttaatgacaaaattcacatcataatagagttttaatttctccattatatcgcgtagggagatatcgttgaaacaaataagcccttctttccaacgaaaatagtctgttgtatgtatcttttctttagtaagttggtttttacttagtctggccatgtcacctggtttcagtttcatgagagatacttcacttttcttttgcagaatttctacagcaccttccaataaggctgtttcccatatactatctttctcataggccagcacattgaattctgtccccagcacccggatattgcatcggttagttccaacaataaaaggttgttttatattagaactgactttaaaatatccttcaccatctaattctacatgacgtacctttttagaaaaccgtcccggaaaagtcaaccggctaccggaattcagccatacatgcgttccatcagccaggtataattcggcatgctggcctgccggaacaactaccgtttgcatattctcctccttgtcttgtaaaacgtggtgagtgtaaaaataagtggttgccacagtaaaaacaatgacagccgctatccgtacaataacatcgagaaccctcctcagcggatctttcttctcttgttgtatatcaacgggacttttagtctgccataacgtaatgtcatacaatttacgttgccgcttatattctctaagatgctgttcatcttcgcgcagccactccattatcctctgtgactctttttcagaggcatttcctgctatatatttttgtaatagttcatccatctttttatcgttttcatttatataacgattcatcttcggtttaccctaaacgaaaaagaatatttttttcaaaagataaaggaacgtgcgtagtaatcggtgttacatatggtaaaaaaagaaataaaataaaggcaggtaatcttttagcgtttttctaagagccttaagtgatttggatatatgatattccacatctttgattgaaatatttaattcgcaggcaatttcccgatttgttttatttccaaatcggctgagagtaaatatacgggaggtttgttcaggtaatgattgcaatgttctttgcacaatatccataacttctttcgagaatatttcatttggattacagtcttccagtgaggagaggcgaagagctaactcttcattttgtttctcactaatccgtgtgatgacctgttgtttcatgctttcatgacgtaagtagtctaaggctttatttcgcaaaatactgagcaacatcggttcaatattttccaccgggttgtcctgtatccattgccacagtttgatgagtgattcagatgcaatatcctcggctaccatctcattgtgtatatacgactttacaaatagaaaagactttttgtaatatcgcatataaatattattaaaagaattctctggacgagtgagttttgcaggcattttaattctttttagttcattaaaaattttgagaaacaaaaatataaaatgatatttgattcgcaaattttctttttagctatttatcccagccaatagatgtagagtgtttggtttatttcgttatcctccttctcatgagtggttggaaaactgtttcccatttgatgtcaatcgttctgttttgccagatgaaaggtgtagtttattttctattcgagagatggtacaagcagtatcgtaatatagaatttatttccgttgagattatgtatggaggagaatctgttcaaaacattagcaaggatgatgtccagagtattgaaataggtataaaaaatcttgttcttgtcttcagcaatggtcttacagtccattactataatctatgttataatacttgaatggactgatcgaaaaatagaggtgatgtgttagcattgaatgatggtattaaagtatggattgagtgtctgctgcgatatactgaacattggccgattgtatacatcccatacattgtaaaagtctctggatgtcttttttttcgtgtggtatgagaatctaatagcgcaatttgtagggataaatagtccaaagacagatatcggttttatgattctgtgcgacttaggagcatgaactgaataatggtttggcagcgaaatatgctgttaaaccattcggttttcgttaaacgaaaacacaacttgctgtcccctaatggggacaacgatttgaatattacgctatatccatatagtgctataaagccttttgtcaggggaaaaacgcatacggtttccgccggtttttctgcatttccgatcttctgaaggggaatatttccccacagaacgtgcgtcttcccgctatactgctataaccatatagccatataaaaaagaatcggaaattgaaatatcattgattgacagcataattcattgattttcgagaatctcttctgtagtctttagtccgctataccactatcggcatagctttagttatctctatttcgatgtcaccccctatgtggttcgccatatcatgatatatcgctatccggctaacccgttataccgctatcaacatatccccgtctattcctatttcgatgtcacatcttatgcggtcagccatatcatgatatatcgttatctgactattccgatatattgccgccttttgtcatccgggacttgcagcggataagataaggatccccccaataaggacttttagtctaaaacaaagtaagctaatgcagtgataataaagttcttatgattatagtttctcctataaaagcattatcttagtagagtaaataaagaagctaacaagttatgaacaagcaagttagaagcattttagcacaagagacaacaaaaacgagcaagatccggcaactgtatcttttagggattccccgtgcggaaatcgcaaggatggtgaccaacggtaattacggttttgtcgtgaacgccctgcgccggatgaatgaacgtgagggcggtctgaatatccatccggcgacagctgcactggattatactttcacccgcaagttcggtatcgagatcgaggcttacaactgctcccgtgaacggctcgcacgcgagctcagggaggccggtatcgaggttatggtggaaagttataaccataccacccgtccgcattggaaactcgtgacggacggcagtctgaacggcaacgacacctttgaactggtcagtccgatcctggtcggtgaagccgggttacaggaactggagaagggctgctgggtgcttgacctgtgtgacgtgaaggtgaacgggagctgcgggcttcatgtacatatcgatgccgccggtttcagcatggaaacctggcgtaacctgtccctgagctacaagcacctggaaccggtcatcgacaggttcataccggcatcccgcagggacaactactattgccgtggcctgggtcatgtctctgacgggatgatacgttccgcccggatggtggacgagctgaaaggaaggatcggtgaccgttaccataaggtggacctcgaggcctactcacggcacaagacgatcgagttccgccagcattccggaacgacctgcttcacaaaaatgcgcaactgggtactgtttctccacaaattagttacctttgccacgaggggacaggtgcctgtggccaccgcgctccagaacatccccttcctcgacagtgaacagaaactatattataaatttaaggactaaaaaaatatcgacatgaacaggcatatatattttagcggatggcggcaggattgccgcctccggcccttccgagtttgtacgcatcctgcgtgaaggcagctggtttgacagcggatgcaccgacgaggagtacatagtgaatttctccggacggtacagggaactgcacggggtgacggtgagaaccgacaccccggagcagttcatggacgacctgaaaaagtacggttacatcaggggctgagaagcccgttccttttattgttacgctccctgccggtctcacatggaccaacagggatttttcttttcatcgccgtagtgttcccgtcctgctgtctcctcgtatatcgctatcttgccaacatgagttcccgctatcttcatagcttgacatatcactattccaataacataagctgttacaatatccgtagcctggtgtaccattatcccaagaatgtaagctgtcaatatctccatggcttgacatgtcacaatcctagcaacatcggggagaatcctggcctcccgccggactgccatttgttatgtcttttgctggcattgactattcatgtctatatatgactataactgacaaggtatcctttcccacgtttattctttttttctttgcagagtaggacgataatccgccatcaggaacatccgccttacaaaacgcccaattgtcacatggaattaatgtataaatcatagttatggacagcattgaaaggaaaaaaacaaaaccgtataatatcaacgagaaggagatactggatatagttgccgctaaaggctcatatttgagcagtatttccgagaatctggaagaggtgccgccccacaaggagtcttcatcccgggcggaaagtaaaaagacgataacggatgaagaggtaaaaaaatacattgaagccctcctgaacaatttttcatccaaccggcgcaagcccctgcatattgatgcacaggtgtacgaatgtatctcagacattgtctgggcagtcagacgtaaggattttactgtttccggtgttataagccgcatactggttgaacatatcaaagaaaacgccggcatgataaagaagatcacaggacgagattacaaactgttacagccgtaatatgacgggaagtcctccttaaaacagctctggagggggagtcggaaatcacgactcccatccggaagtgcatttggaaagtattttgaactgtatttcaataatttgagtttctaaaaggaagctattttaaataaaaacaagaaaaatggaagtatattacattgaagccggaatctttgaggaaatgctggctagggctgatagcctgtccgcacaggtggaccgcttgtatgaaaaaaacagggaaaagaaaccgggagagtgaatggataaccaggatgtctgcctgcgccttgacatctctccacgtaccctgcagactctccgggataccggacggctggcattcacccaaatccaacggaaaatctactacaggccggaggacgtggaaaagctgatggtctatgccgccatgaaacgcaaggaaaaggcggtgagagaaaaaagaaagaatgaataattaattggatgcaacatggaaggaattattagcaaagagacgtgcagtgtccgccgattctttggcctgctggataacattcagacgaagctggaaaggcttgcggaggataaccgccccctgtttaacggtgagcgttttctctctgacaaggaattgtcggacctgttaaaaatcagccgcagatgcctgcaggattatagggaccaggggcgtatttcttatatccggctaggtggaaaaattttgtataaggtatccgacattgagaaactcctggaagataattatcatgaggccctgatataatcggacgttcaatactcaagaatgccggccggaaccattaaacatcggtttcggctggcatttcattattcggatatttccgttagggggaccgtactccctttctgtcttcttttcatcagccggtccatgtcaccggatatcttctggtcggtaacctatgcatagacctgcgtactgttgatgttcgtatggcccatcatcttggcgatgctctctatcgggatgccggaggacagcatcagggttccaaacgaatgccgtgcggtatagggcgtgacatcggaataaggataaacggggatatgctgatagtgatataacatgatatggtgagctgcatagaggatgacctcgaaatagagataactaaagctatactgatagtggtatagcggactaaagactacagaagacattcccgtaaatcggtgaattatgctgtcaatcaatgatattttaatttctgattcttttatatggctatatagttatagcagtatagtgggaagacgcatgttctgtggggaaacatttacattcaaaaaaccggaaatgcggaaaaaatggcagaaaccgtatgcatttttcccctgacaaaaggctttatagcactatatggatatagcgtgatattcaaaacgttgtccccattaggggacagcaagttgtgttttcgttaaacgaaaacaggacggtttaacggcgaatatgccgacaaaccatcccagcctttgcctccggagttggtatgtttataagtgaaaagacaacagtattaaaacagaagcaatttagcatatttaaaaaatcataattcatttcagccttgacattttatttttaaagcataactttgtgttcggataaataaaaatagcttcttatggtatattgtaacttattgtttttgatatttttataaatataatataactagatgtacatatccaataacgcttacagcggtttgaactcacttcgtggagggctgaagcatagctattggagcggttcatcacttcttgacacgacaacctttcaatctgaaagtggaaagccatcatgtaattatacgatttcccgaaatatgcagtttggctttcaggacaccctttctatggattccaatgtttttttcatacgctgatggggaatgtattggtacacctatctatttcttttttgcttccaatacggtgtcctaaaggatacctcacaaaggcttaattttaacgaactggcccgtgtaacgaaaaaatacagtttatccgtgagagtaactggtgctgccgacagttctactggtacatcaggtatcaacgattctttgaatatatcaagagcttgcttggttgctacagaactggaatgacatggaatatcggccgaacgtattatcagaattagttaaggagaaattgccgactatacacctgcggaatccaacagatatacgaaagtagagttgttttttcagaagcgaaatagaaatttcacataattgatatttaattttatcacaactaataaagcctccccgctgtgaaacgaaaagttttttttcgatatggtacacgctatgccgccatttccataccgtcgagaccagagtaaaaattacttcgaggcttcgagtgactcttttctgaaacgtttgaggagtttttcaagttcgagtgatgctttgcgggcacgggttccggcagctttgtttcctttttctacctggaggctggcatcttttgaaaattgatcaaacaattcactgatttgtgcaaatgttttttccatggtcatatttttaaatgttatacaatacattttacggtgttgtaaatcagctttttatcctttgcacttttttgtatttgttagcttataatttatagaaacgtaggaactttgttaacatcatctttgttttgtataaagttaattataaaaaaaaatgaagcgtatggaaaatggtgttatgatgcaatattttgaatggcatctcccgaatgacgggaagttatggaaacagataaaggaagatgcgttgcatcttcatgatataggtgtgactgctgtttggattccccctgcttataaggccgatgagcagcaagacgaaggatatgcgacttatgatctgtatgacttgggcgaatttgaccaaaagggaaccataagaactaaatatggtacgaaagatgaactgaagaaaatgattgacgaattgcacaaatatcatattgctgtttatctggacgttgtattgaatcataaagcgggtggtgattttactgaaaagtttatggtagtggaggtcgatcccaaggagagaaccaaggctttgggtgagccgtttgagatacaagggtggaccgggtatagctttcacggacgtaaggacaaacattcggattttaaatggcattggtatcatttttccgggacgggttttgatgatgcgcaaaagcgcagcggtgtttttcagatacagggagaaggaaaagcttggagtgagggcgtggatagtgagaacggtaattatgattttctgttatgtaacgatattgacttggaccatccggaagttgtatctgaattgaaccgttggggaaagtgggtttccaatgaattgaatctcgacggaatgcgtctggatgccattaaacatatgaaagatcaattcgtcgcacaattcctcgatgcggtgaggagtgaaagaggcaatgatttttatgccgtaggtgaatattggaatggtgacctggaagcattggatgcttatatagaagctgttgggcacaaagtaaacctatttgatgtcccgttacattataatatgttccaggcatcacaggaaggtaaagactatgatttgcgggatattttaaaagatactctggttgaacatcatcccgatctggctgtaaccattgttgacaatcatgatacgcaacgcggaagttctcttgaatccaatgtagaagattggtttaaaccgttggcttatggtttgattttgctgatgaaggaaggttatccatgtctgttttatggagattattatggtataaagggggagaagtctcctcatacccggattattgatatattgttggatgcgagacgaaagtacgcttacggtgatcagatagaatacttcgaccatccttcaacgattggctttatccgtacaggagatgaggaacataatggctccgggctggtcttccttatgtctaatgacgaggcgggaagtaaaataatgagcttgggtgagaaacataaaggcgaagtctggcacgaaataaccggaagtatatccgaagaaataactttagatgaagaaggaaatggagagttctctgtcgaatcccgtaacctggctgtttgggtgaagaaggattaggttatggtatttatataattaattatgaagatgcttgttacagttgtaatcaggtatcttcatgatttgtatgaaagtcatttgcagacagaaagattctctgtatctttgccgccatggcagaaagaagcgaactacatacgagaaataaacacaatggacaatatgatttttcattgttgacagagaattatccaccgctcagaaaatttgtacttctcaatcctttgggaatacaaacaatcgatttttttaatccacatgctgtgaaagcgctgaataaagcattgctgataagttattatggtatccgctactgggatattccaaggaattatttgtgtccgcctatccccgggagggcagactatgttcattatattgccgatttaattgatccggagagagtcagtaatacggcaaatgaagagaatggagataagccaaaacgacagtgcagatgcttggatatcggtgtaggtgcaaattgtatttatccgattattgggcacgttgagtatggatggatgtttgtgggttccgatattgatccggtatccatagaaaatgcgcgtaagatagtgacttgcaatcctgtattagcacataagattgatttgcggcttcagaaagacaatcggaggatttttgacggaatcatcgctcccgatgaatattttgatgtaacaatctgcaatcctccgtttcacagttcgaaaaaagaagcagaagaggggacattacgtaaattgagtagtctgaaaggggagaaagtaaagaaaaccaaattgaatttcggtggaaatgcgaatgaactttggtgtgagggtggagaattacgttttttgctgaatatgatttctgagagccggaaataccggaagaattgcggttggtttacaagtctggtttctaaggagaagaatctggataaactatatgctaaattaaaagccgtccatgtatcggaatataagataattcgaatgtgtcagggtacaaaaaatagcagaattttggcttggcgatttttggaatagctgattttgttttttttcgataaacggatatttttaaagaagattatctgtataatgaaaaaatattgatgattaagaccgttatttgttataatgtgcctggatttgttgttgttttcgataatagagtcgtttctctctctgtatattctatatgagtattaattcccctttctccttttctttgatatgccgatatttgtagtatgagattatagtgctaggaaatatcaaatcaagggaatatatgtttgttgttagattgagaaactatttacatttgtcgtttttggttatatttttattgttttcctcctgtattgatgagttttataaagatacacctaaagagggatatataacaattaccggtatcaatacacgtgcctatacaggagcctatccgggtgacgggctcgatgataaggttgaaactctgcgtattctggctttcaataagacaagtcgcatctgcgaaagtaatactttttattatggagatgtgctgggcggaaatacgctacggcatccgattaataagggtgaatatgattttgtctttttggccaatgaacctcataatacaattgtgaaggcggttcttgacaatataactgattatgatgcactaaagtcaatatcctatccggcggagttcttcgattcggaacgggttatacctatgattgcggaaaataatagtataaaagtgctggctgatggaaacttggaggtaaatggtgttgcatctaccaagttgacagtaggactcagacgcttggcggcacgtgtggatgtggttttgaaatcgaaagtcgattttggtgatgccagttcgagtgaatttgaaggaattactttttctaatataccggatagagtgcctttggtatatggcttgcctagtgattgtttacccagttcctgggcgtatgccgatccggttcttccttatggtggaacggccataaccagaaatgtggaacgtaaactcacattagctgataatgccgactgttttaaaatagatcccactttattgaccactgaggataaaaataacgatttagtctgggctgttaaagttaaaaaagtaattctgccatctagcttcttttcatcgaagtccgacgagacgaatgcgataaattttactgttaacctgattgacaagtatagtccttcctgcaaattgaagattctgtccgacccggattatacattaccggcaaatgcgaaacttgatttgacaggtatcataagagaacctttagaagtaaatatacagccttctccgtggattgacgatggagatgattgggaaatatcaggcgtccgtgttctgaatgtatcgcatatacaggctaagatgacggatatgaacggagtccggatttctttctggtccaatatgccggtagtgaaggtgttgggcatagtaaagaaagaaggtgaagcgaatgaaagagcaactaatacagtctttaactgtttggcagtagatgataataatcctgatccttatcgtttcttttatgattcggcttcgggcagcggatatatggatttactggttgacggaacaaataccaccggttttggtacgcatgacaggaccgagaatatgagtggtacatatacattgacattatctgcagcagaggatactaatggtaagaatgcattgcagaggaagataaaggttaccgtcacacaagaaggtttgcgatttgttcacaatcctacggcaaatcaacatggtttgttcaatgcagcattttttaaacataaccagaaaggagaacgtattataacaggacagcatcgattggatcaaacatggtctgttagtgtacctgttgcctatcaaaactggcttgttgtgagcgcgactcccagctttgatccgaatattggaacagaatcaccgggtgatgcggaacattatccggtgactctcaatccgtataggggagaagatggtactagtatctcaggtctcaccggtcgtatatatttccgtattggcgttaaggaaaatgccgattttgtaccaactaaagaatccgagcctaaatttggatatatcaatttgtcatattatccgggatggcggacaacaatgaaaatttatattcgtcaaggcgaagccggtgcttatatatatgcaccgggggatgctatttcgggaactgtatggggagcgtggaatggaggtacggatattactacacatgtgagagaagatatgcgtcttttatcgacgaatgcccgtaggggagcagctaagttctctgctttaaacctgacaagcgagaggttagcagggaatacgaatccggattatgagaatgtgaacgtaaaaggtgctcgttttgtagacttcccttcgcaggcgggtgcattctttcagtgggcggtcgatttgaaaggcactacttccggtatgactgattattaccgcagagcttttaatccctcgaagtcatatcttgtttcaggattcccttggggatatggggaatttccgatcatgtgggatggagatgtcagtgctaatattcctgcatataaagaacagtttgaagtttgccctccgggatatcgtcgtccgacggatggctatacggataaaatatcttataatggatattatgattatttgccggatgagggtactacgggtactgccacgaattataaagatcaaatagagtattcagaattaagggtttctttatttaatgtaccttttgcaggaaatgcggcttcaagtgcagactacgctacagcttttactactccttttggtggaactggtaatacaggtcctgggacatatccttacggagcaaacaaagatatgcttgcccggaaacaactaaaaggaacaacttatacattttattcggacggatttttcgacagacgtccgataaaagaggcttcgaatggaaactatggcgtatcattaggaaatagtaatgttgcttatcagggagtattgtattttaatcccgattccggaacgaatgcatctgtcttttttccgtcagccggtcgtctgaataacacaagtggtgctttggaaagtaggggtagtaccggatactattggtcggcaagtgtaggtcctccttatatgagatcggaattgcagaatccaccttatgacaggagaatacgttatggagcctggtcgcttgagtctgcatataattctcataatttcagattgtcatatcaaggttttgctcaaagtatacgttgtgtgaaagaataagaacttttcggcttacgataaaaataccggaatatcatccgttgaggggttggctttttagtcaaccccttatttgtgcgtactctctaacaacaaaactgctgttttaagaagaaatctttatttactctaataagattctaataggattctaactattctctaacaggctctccgaagggagccgtctatctttgtgcccggaaatccggttactaacttaacttatgtttaattatgatgatgaagagagagttacacacatttattattggcagtgtgttgttttttaccgcatgcggggataaacaggaatcagagcaaaaaagtggctatcgtatacaaggtgacacggtctatattgcagatcctcttttacttgaaaagatcaaagtatcagtgtctgaactgaaaccctattccaagaaggtgataacgtccggtgtggtgcgtcccattcctccccgttatgcttatgttgctcctccatttgcagggagagtcacaaaatcttatgtgcgtatcggacagtcggtacgtcagggaacacctttatttgaaatcagttcccccgactttacttctgcacaaaaggaatactttcaggcactttcgtccagggaacttgctaaaaaagatttgaaacgcaaagaagatctgataaggaatggtgtcagttcgcaaagagaactggaagaagcccagaatgctttattgatagcagataaggagtttgaaaacgcctctgccgcattgcgggtatatcaggtggacaatccggcggaaatgatattggggcaaccgatgattgttcgttctcctattcccggggaagtgataaaggataacatcgtaacagggcaatatctgaaagatgataccgaaccgatagctattgttgccgacctgtctaaggtatggattgcggctcaggtaaaggagaaagatatccggtttataaatgaaggcagtagtctggatattgaaatttcggcattgcccggtacggttattaaaggcaatgtgtatcatgtagaggaggaggtagacgaggaaacccggtccattcaggtactttcggtctgtgataatttgaacggacatctgaagctggggatgtacactactgtccactttctgagtgttccggtcggacaaattcaaatcccggagaaaacgttactacagggcgaaaaggatagctatgtatttgtgcagattgctccgttggttttcgtacggacgtcggtgacagtggagacaacagaaaacggaatagcggtgatcagcgaaggattgcgtcccggagataagataatcagtgaaggaggatattatttaaagtaagaaattatgaagaaggaattaatgctttcaattatacaaaaaagatgggtaatgctttgcctgtttgtgatgatgtgtatctttggatattactcatggaaacagctttcgatagaagcatatccggatattgcagatgtcacttcccaggtggtcactcaagttcccggactggctgcggaggaagtggaacagcagataaccattcctttggaacgcgctattaatgggctgcccggtatgcacgtcatgcggagtaagagtacattcgggctgtcaatgattaccattgtctttaaggacgggacagaggactactggagccgccagcgcgtacaggaaagattgaatgaagtagaactgccttatggagctgttccgggacttgatccgctgacatctcccgtaggagaagtgtaccgttatatcatagaaagtgaccagcactcattacgcgaattaaccgaccttcagaactgggtaattattccccgtatcaaggaagtgtcgggagtggctgatgtaaccaatttcggtgggatcactactcagttccaggttgaagtagatccgtccaaactggaacaatataatttatctctcagccaggttgttgaagccattgagaataacaatgccaatgtggggggaagcgtgttgaatcgtggtgacttgggttatgtggtacggggaattggattaatcggaaatttggacgatttgggacatattgtagtgagtactacttccggagttcctgtctttctgaatgatataggttctttgaagtatggaaatcttgaaagaaagggagtgctgggatatacggaccgtacccgcaactactctgagagtctggaaggaatcgtactccttctgaaacatgagaatccgtctaaagtactggaagatattcatgtggcagttgatgagttaaataatgagacattgccggaaggagtgaggatacatacttttctggatcgtaccaacttggtggatactactttgagtaccgtatcccataccttgctgatgggtatggctttggtgtttcttgtgcttattctgtttctaggcaactggcgtggtgcattattggtatctataacgattcctgtgtcattgcttatcgcttttattcttatgcatctgacggatattccggctaaccttctgtcgcttggtgctattgatttcggtattattgtggacggtgctatcgttatgctggaaacgatccttaagaaacgtgaggataatcccaaacaatatctcgaagaaaaaagcatggcgcaacgcgccaaagaagtgggtcggcctattcttttctcaaccattgtcattattacggcataccttccgctgtttgcctttgaacgtgttgaacgcaaactttttactccaatggcatttacgatgagctatgcaatgattggagcactgttggttgcgctcttattgattccgggacttgcctatgcaatctatcgtaaaccacataaaatatataagaataaatggctggacagactaaaggataaatacattcgtaccattacaagatttctggaagctcccttaaaagccatcattccatcaggactgattctgacagcggggatcgtgttgagtgttgtcgtaggaaaagacttccttccggagctagatgaaggttcgatatggttacaggttaatctgccacccggaatttccgtagaaaagtcacgggagttatccgatactttgcgtgcccgtacgatgaagtattccgaagtaacttatattatggtacaggcgggaaggaatgacgacggaactgatccgttcaccccttcacattttgaagtgtccatcggtattaagccttatgatgaatggccgaaaggaaaaactaaaaaggatttgattcatgaactggaagaagaatataagttacttcccggttttaaagtaggatttagccaacctatgatagacggggtgatggataagatagccggggcccatagtgaactggtggtgaaagtatatggcgaagattttcgtgaaacacgtcgtattgccgaagaaataaccagggcattaggaactgtgcgaggggctgttgatctggatattgatcaggaaccacccttgccacagttacagatcagtatgaatcgtgatgccatagcccgttacggattaaatgtatccgatgtagcggatctgattgaagtggctgtcggaggtaaagctatcgcacaactttatcagggtgaccgccagtatggcatcacctgtaagtataaagaggaagcgcggaatactccggagaaaatagccggacttatgttgacttcttccaccggtgcaaagatacctctttctcaggttgccgatgtcagattgagtgtcggcgaaagtacgattaccagggaaatgaacagacgccatttgacggtaaagctgaatttgcgcggtcgtgacctgacatcttttctgaatgaagcccagaatacgatcaatgagaaagtacattatgacaagaataaatataccatcaaatggggaggggccttcgaaaatcaaaaacgggcttatacacgtcttgctgtcattataccgctgacactgacagggatgtttatactgctttatgtcacgttcgggaagttccggcaggcaggactggtattggctattgttcctctggcacttttcggaggtatgcttgctcttaatgtgcgtggtatgacgctgaatgtatcttctgccgtaggatttatagcgatgttcgggctttccatacaaaatggaattatcatggtatcgcaggtcaatgggctgcgcaggggaggaatggaactccggaaatcggtcatagaaggggcacgccagcgtttccgacctattctgatgacttcgatcactacgatactcggacttttcccggcttcgttggcaaccggaatcggtagtgacgtacagcgtccgctggcaacagtgattgtgtatggattgatgttttcaacccttatctctatgtttctgcttccggctttctattatctggttgagaacaatgttttaaataaaaagaagaacgatgaaaaagaatatacgatataatatagtgctcttgctgttaatggtggaagccgtactcattccggcttttgcgcaaatgcctgaaataaagctggggcagtctatttctttcgaagaatatctgaatcgggtagcgaaaaagaacctgagttatttagccgaaaaactcaatgtgagtattgctgatgcggaagtaattgcccggaaaatctttccggatccggagttggaatttgaagcaggtaatgagactttctcgttgggagtttcctattcattagaaatgggaaataaaaggggagcacgtattaagttggcgcggactcaggcagaattggagaaactggtcctgcaacagggctttcaggatttgagggcggaggctgccgacctttttctagaagcaattcttcagcgcgaattacttgaagtacagaaaagttcttatgagtatatgtatcagctgagtcagtcagatagtttacgttatgtttcgggagagattacggagaatgatgtccggcagtcaaaactggaaactgtcaccttgcttaatactgtttacagtcaggaggcggcttatcattccgctttggttttgttgaataaacacatggggatgagtgctgatacgcttcatatccctttgggaaattgggaagagctaagcagggactttgctctgtctgatttggtcaaagcgggactggataatcgcatcgacctgcttgttgctcaaaaaagtactgaagttactacccgggaatataaactgacgagagcggaacgcagacccgatatcggagtatctgtttcttatgaaagaaactggaacggctttcttcctccgtcccgttctgctactgccggtgtatctgttcctctgacattctcgaatataaataaaggagctgtaaaagctgcaaagtttcggattgcccaatcggagataatggaaagagatatggaattgcagatacagacagagataacccaggcctggttcaactatgaggctgaaaagaaaaagatagctcaatataaagccggtgtacttgaagactcgcagaaggtgctcgacggaatggtatataaatacaaacggggagaaacgagtattcttgatgtactggttgcccagcgtacttataatgaagtgcaacaggagtatctggaaacaatgaaaggatatgccgcttcactagtagcattggaaagagcttgtggtatatgggatatatgcttttgacagttaaatatccggctttactattgtgaattgcagcaaagccggatatttgtatggttaccagtcagcggtttcacgctttatgttaaatcattgtgcgatattcctcctgttttttcttagggagtttttttgatcacttcttccacagagtggtcaataagttctttgataagtttgtcactcaggtttatttacttatctgttttccgaactttaatccgtactactgtgtcattttgacgagactggacaatgttttattactttcgattgtgtatctttgctgtagttgaaatggacaaccggaatttatatactaataaacagaatattatggaagcgaagtatatcactctgactaaagagaatatcgaaaaagaacatatttgctgtgctttctccgataagaaatgtaaggatagctatgagttgaaaaagacatggctgaaaaatgagtttgagaatggctatgttttcagacggcttgacgaacgtgcaaaagtatttatagaatatggacctgccgaaaaagcttgggttccggttaatgcacctaactatttaatgataaactgtttttgggtttcaggaaaatataaaggatgcgggcatggcaaagcactattgcagtctgctgtcgaggatgccaaagcacagggtagggatggcttggtgactgtggtcggtacctctaaatttcattttatgggtgatgcgaaatggttattacgtcaggggtttgagacgatagaaaaactaccctatggtttcagtcttttggctttgaagataaatccggcagctcctgatccgtcattcaatggaacagtatcaagtggagaatgtgaggaaaaagaaggtgtagtcgtttattatacacatcgttgtccgtttgcagagtttcatgtccgtaattctttagtgagtgtgactgagaacaaaggtattccattgaagatagtcagattggaaacgatggcacaagcacaaaatgcacctacacctgctactatcttttctcttttctataaaggaaagtttgtaacgacggatttgagtgcatgtatggagcaacggtttgataaagcgttgggattataatctttcttattacagtatgtgtttctcttttttgattttctgtttttgtgctgttttgctctgatgagtgtggcgggttaataattgtctggtgtttatttagactggtcggttcgatttttcatgtgctgctctgatcttatgcagattcattaatagaatcggcagtttatttatatgttgagatgttttgttttatgtatgtgacatatgcttgatttttagtattttattgtatgtggttggtggggaaaacttgatagctcctgacttttataatcactaacttttcttattttagttcattcaaatatgttcaattcttgcattttatgaaactatgttttacttttggggagtaaaatcattgggattataatgaaaagtattcgctcggttatttgtttttgtttgtttttgtttgtgtttaaccagctccttttcgccgacaaaactatagagaatgattcgctatataccagtgagtatataagtcgaatttatatggcagaacctgaacgggctttaagtttgttggatggagctgaaagtaagaagactatccctctgcgtattatacatgaattacgcagcagggtttatcgtaatatgtatatgactaaactggcttttttgtatgccaaaaagtcttatttgctggattccgtttctcagaaagatactaagcacttgttgaccatgactgtcgacctggcagaattagcagtgcttatgagtgaccataaagagagtatgaggtatgctcttgatggtatcaagctagcacaaaaagaaaaggataaaggggctgaaagtaagctgttgttttgcattggtgaaaataaatggcaattgtctttcaaagaggaggcatatgactattttgacaaagctatcaaattgcttcaaggtacaagttccaaattggaaatggctatgctttcatacttttatgggatgaaaatggattatctgctcaatgattcccgtagtaaagaagcattggaggttgggttgaagcgcgaaaagctacttaaagatatagctaaattaccggaaaaaacaaaaggctttcttgatctgcaatatacttacttgtatgcaaaaatgtcgtatatctgctatctggaaggaaagtatgatcaggcggaaaaatattatcaacaatatttgtcaacagagaattcacagacaccggatggaaaaacctatgcgataccttatctgctagtgtctaaacaatatcagaaagtcgttgatcaatgtcaggattttaagaaattgatgcaagagcaggatactgtcaacttgcagtatattagtatccttcagaaagaggtgaaagcttataaaggcttgaaggattttgaaaaagtagcagcattacgtgagtctattatttctattattgatggtattaacagcaaggataaacagaatgcggctttggaattaaatgctattcataaagctgacgagcaggaagaatatattgccgaacagactttacagttaagaatcagaaacatatcacttgcttttttgggatgtgtcacttgtctcattttatttgtgctatggcggatttggcgtcatacgattattgttaaatataaaaacaaaatgctggcaaagtttatcaatgagaaactggctggaaaagtagagaacaaacaattattcatagatggagatgcggaagatccgatagctgttccattggacttggaaccggaaactggcttttccgaaaaagacgatttatctccggatgaagtagtggagagtagggaggaagaggatgagaataagaaaattttcaaagaactgaatcgtattgttgttcaggatcagttatatctgtctccggaattgtcgagagaggatctggctcagattgtacatttgaataatgcgcgtttcgcccggatgatcaaggaaaacaccggaactaatttcaacgggtatattaatgaacttcgtattaactatgcgattcagttattgaagcaacatcccaattataccattcgtgcgatagctgatgaagccggatttaatagtacgcctattctgtacagtatgttcaagaaaaagactggtatgactccttacgaatttaaaaaaacgcaggaatccttaggttgattttggctttttcgataaacaattttccgttttatcggtttattcttatgataactaaatataaacggaaatggtgcaagttaggataaagcgagtgtacgaagacttttcagagaccgacggatatcgggtgctggtagataaactctggccacgtggaatcaaaaaagaatggttgaaatatgattactgggcaaaagatataacgccttccgcagcactgcgcagatggtttcatgaagatattccgggtcactggaatgattttgtcgtaatgtatcagaaggaactggaagcttctcaagctgttgccgattttctgactcttatcaaacctcatccggtgatcactttgctttatgcatccaaagaaccggtttataatcatgcccgaatccttcgtgattatttggaaatgcatctgaaagagtgaaattaaagtaatttttatctctttccgctttcagtcgttcactcaatttcctacctttgtaatctaaatcaaaatcgtgtgtccatgaagtataaattattagttcttgatgtagacggaacgcttctcaatgatgcaaaagaaattagtaaacgtacattggctgctttgctgaaagttcagcagatgggagtacgtatcgtgttggcatccggccgaccgacttacggtctgatgcctttagccaaatccctagaactcggaaattatggaggttatatcctttcttataatggttgccagataattaatgctcaaaacggagaaatactgtttgagcggaggattaatccggaaatgttgccttatctggaaaagaaggcaagaaaaaataatttcgcactgttcacttaccatgatgatacgatcattactgacactccggagaatgaacatatccagaatgaagctcgcttgaataatttgaaagtgatcaaggaagaggaattttctgtagcaattgactttgctccgtgtaagtgtatgcttgtcagcgatgacgaggaagcgttggttagtctggaaggacactggaagagacggttgaacggagctttggatgttttccgttccgaaccttattttctggaagtagtgccgtgtgcgattgataaagccaacacattgggagctttattggaagaactggatgtgaagcgtgaagaagtcatcgctataggagacggtgtgtgcgatgtaacgatgattcagctggcaggactgggagtggcgatggggcattcgcaggattcggtaaaggtctgtgcggattatgtgacagcttccaatgaggaagacggagtggctctggctgtcgaaaaggcgataatagcggaagttcgcgctgcagagattcctttggaccagttgaatgcacaggcgcgtcacgcattgatgggtaatctgggtatccaatatacatatgccgacgaagaccgtgtagaggcgacgatgccggtagatcaccgtacccgtcagccgttcggtattttgcacggtggagctacgcttgcattgggagaaacagttgccggactcggctcgatgattctctgtcagccggatgaaattgtggtaggaatgcaggtcagcggaaatcatatatcttctgcgcacgaaggtgatacagtacgtgcagtagcgacgattgtacacaaaggacgttcctcccatgtatggaatgtggacgtttttacttcaaccaataaactggtgtcctctatacgggtggtcaacagtgtgatgaaaaaaagatgattgacgaaaaaagtaacttgacaactattgatgcacttattcagcggaaacagccctttgctgtttatcgtgttcccggggagaagtatcctcgtctgttgacagaagatgtcggagctgtccgcttgattttcgatttgaaagaactgaatggacaaagaggatttgtgattgctccgttccgtatagataagtcatgtccgattgtgttgatacagtccgacaggactggacaaccgttgcctatggaaatcgtggcagaggaagagcaggacttgcaaagttatccggaggaatcttttcataccctttgtactgggaagtatgcgacctgttttcatacatttattgaagccttgcgtgatgctacctttgataaactggtgctttcccgtagtctcactattggaaagaatccggagttttccccttcagctgtttttcgtgcagcttgtcaacgttatattcattcctatatctatctgtgttatactcctcagacgggcgtgtggctgggaagtacccccgaaattatattgtcgggcgaaaaaaatgaatggaacacagttgccctggcaggaactcaacctttgcagaatggtaaacttccgcaagtatgggatgacaaaaaccgtcaggagcaggattatgtggcgtcctatatccgtcggcagcttctttcgctgggcattcgctccacagagagcggaccttatccggcttatgccggtgccttgtcacatctgaaaactgatttccatttctctttgaaagataataaaaatctgggagaccttctgaaagtcctgcatccgactcctgccgtgtgcggactgcctaaagaagaagcctaccggttcattttggaaaatgaagggtacgatcgtaagtattattccggttttatcggttggctcgatccggagggacgcacagatttgtatgtgaatctgcgttgcatgcacattgaagacgagcaattgacactgtatgccggtggcggattgttagcctcttcagagttgaatgatgaatggcaggaaacggaaaagaaattgcagaccatgaggcgtattcttgtgtctgctccaataatgatgaatcactaacaagctaatcactatcaatatgtattcggacaagaaaaatatactccagttggtcgcgctgcttgaggcgcatggaattacgaaagtagtgttatgtcccggtagccgtaatgcacctattgtgcatacgctgtctactcatccgggttttacttgttatgctatgacggatgaacggagtgccggttattttgcgattggtcttgcgctgaatggcgggcatcctgctgccgtttgctgtacttccggtacagcgttgctcaatcttcatcctgctgtggcagaagcgtattatcagaatatacctttagttgttatctctgccgatcggcctgctgcctggattggacagatggcgggacagacattgccgcagcccggtgtttttcagacattggtgaagaagtcggtaaaccttccggagattcagacagaagaggatgaatggtactgtaaccgcttggtgaatgaagccttgctggaaaccaaccatcatggaaaaggtccggtacatattaatattcctatatccgaacctttgttccagtttacggtggagtcgcttcccgaagtacgtgtcattacgcgctatcaggggctgaatgtatacgaccgggattacaatgacctgatcgaacgcttgaacagatatcagaagcggatgattattgtcggacagatgaacttgatttacttgtttgagaaacggcataccaaattgttatataaacatttcgtgtggctgaccgagcatatcggtaatcagacagtacccggtattccagtgaagaattttgatgcggcgctttatgcgatgcccgaagagaaaaccggccagatgactcccgagttattgattacttatggcggacatgtggtttccaagcggttgaaaaaatatcttcggcagcatccgcctaaagaacattggcatgtgtctgctgatggagaagtggttgacctttacggttctctgactaccgtcatcgaaatggacccgtttgagtttctggagaaaatagctccattgctggataaccgcgtgccggagtatccccgtgtatgggagaattattgcaagaccattcccgaaccggagttcggatattcggaaatgtcggctatcggtgctttgataaaagcattgccggaatcatgtgcattgcatctggcaaatagttctgttatccgctatgctcagttataccaggttccttctacgattgaggtatgctgtaatcggggtacaagcggcatcgaaggctcgttgtccacggcagtgggatatgccgccggttcggataaactaaattttatagttataggtgaccttagtttcttttatgatatgaatgctttgtggaacatcaatgtccgtcccaatctacgcattcttttgctgaataacggaggaggggagattttccatacattacccggactggatatgtcgggtacatcgcacaagtatattacagccgttcacaagacatctgccaaaggatgggcggaagaacgcggattcctttatcaacgggtagagaatgaagaacagcttgccgaagcgatgaaaacct

(The sequence listing continues in the following parts.)

The invention claimed is:

1. A pharmaceutical composition that comprises:
(a) an amount of a *Bacteroides thetaiotaomicron* bacteria strain deposited under accession number NCIMB 42341, wherein said amount comprises from about $1\times10^3$ to about $1\times10^{12}$ CFU/g of said *Bacteroides thetaiotaomicron* bacteria strain with respect to the total weight of the pharmaceutical composition, wherein the *Bacteroides thetaiotaomicron* bacteria strain is live and viable; and
(b) a pharmaceutically acceptable excipient, carrier or diluent;
wherein said pharmaceutical composition is a lyophilized composition.

2. The pharmaceutical composition of claim 1, wherein said pharmaceutical composition strain is encapsulated.

3. The pharmaceutical composition of claim 1, wherein said pharmaceutical composition is formulated for oral delivery.

4. The pharmaceutical composition of claim 3, wherein said pharmaceutical composition comprises an enteric coating.

5. The pharmaceutical composition of claim 1, wherein said amount comprises from about $1\times10^6$ to about $1\times10^{12}$ CFU/g of said *Bacteroides thetaiotaomicron* bacteria strain with respect to a total weight of the pharmaceutical composition.

6. The pharmaceutical composition of claim 1, wherein said pharmaceutical composition further comprises at least one prebiotic compound.

7. The pharmaceutical composition of claim 6, wherein said at least one prebiotic compound is selected from the group consisting of, inulin, a transgalacto-oligosaccharide, a fructo-oligosaccharide, a chitosan-oligosaccharide, an isomaltooligosaccharide, a pectin, a xylo-oligosaccharide, a beta-glucan, an arable gum modified starch, polydextrose, D-tagatose, acacia fiber, carob, oats, a citrus fiber, and any combination thereof.

8. The pharmaceutical composition of claim 1, wherein said amount comprises from about $1\times10^8$ to about $1\times10^{10}$ CFU/g of said *Bacteroides thetaiotaomicron* bacteria strain with respect to a total weight of the pharmaceutical composition.

9. The pharmaceutical composition of claim 1, in the form of a tablet, capsule or powder.

10. The pharmaceutical composition of claim 1, further comprising an additional bacteria strain.

11. The pharmaceutical composition of claim 10, wherein the additional bacteria strain is *Roseburia hominis*.

12. The pharmaceutical composition of claim 1, wherein said pharmaceutical composition is formulated for enteral delivery.

13. The pharmaceutical composition of claim 1, wherein said pharmaceutical composition is formulated for rectal delivery.

14. The pharmaceutical composition of claim 1, comprising the pharmaceutically acceptable carrier, wherein the pharmaceutically acceptable carrier is lactose, starch, glucose, methyl cellulose, magnesium stearate, mannitol, or sorbitol.

* * * * *

UNITED STATES PATENT AND TRADEMARK OFFICE
CERTIFICATE OF CORRECTION

| | |
|---|---|
| PATENT NO. | : 10,226,489 B2 |
| APPLICATION NO. | : 15/631945 |
| DATED | : March 12, 2019 |
| INVENTOR(S) | : Angela Margaret Patterson, George Grant and Imke Mulder |

Page 1 of 1

It is certified that error appears in the above-identified patent and that said Letters Patent is hereby corrected as shown below:

On the Title Page

Item (30), Foreign Application Priority Data, please insert:
--(30) Foreign Application Priority Data
Dec. 23, 2014 (GB).......1423084.1--

Signed and Sealed this
Seventeenth Day of November, 2020

Andrei Iancu
*Director of the United States Patent and Trademark Office*